US010358485B2

(12) United States Patent
Roberts et al.

(10) Patent No.: US 10,358,485 B2
(45) Date of Patent: *Jul. 23, 2019

(54) ANTI-TAU ANTIBODIES AND USES THEREOF

(71) Applicants: Eisai R&D Management Co., Ltd., Tokyo (JP); UCL Business PLC, London (GB)

(72) Inventors: Malcolm Ian Roberts, Hatfield (GB); James Martin Staddon, Hatfield (GB); Hettihewage Alfred Rohan De Silva, London (GB); Jared Spidel, Downingtown, PA (US); Hirofumi Aoyagi, Ibaraki (JP); Shigeru Akasofu, Ibaraki (JP); Yutaka Hashizume, Ibaraki (JP); Kishan Agarwala, Ibaraki (JP)

(73) Assignees: Eisai R&D Management Co., Ltd., Tokyo (JP); UCL Business PLC, London (GB)

( * ) Notice: Subject to any disclaimer, the term of this patent is extended or adjusted under 35 U.S.C. 154(b) by 0 days.

This patent is subject to a terminal disclaimer.

(21) Appl. No.: 16/217,360

(22) Filed: Dec. 12, 2018

(65) Prior Publication Data

US 2019/0112365 A1    Apr. 18, 2019

Related U.S. Application Data

(63) Continuation of application No. 16/161,586, filed on Oct. 16, 2018.

(60) Provisional application No. 62/572,910, filed on Oct. 16, 2017, provisional application No. 62/577,011, filed on Oct. 25, 2017, provisional application No. 62/697,034, filed on Jul. 12, 2018.

(51) Int. Cl.
| | | |
|---|---|---|
| *C07K 16/18* | (2006.01) | |
| *C12N 15/85* | (2006.01) | |
| *C12N 15/62* | (2006.01) | |
| *C07K 14/47* | (2006.01) | |
| *A61P 25/28* | (2006.01) | |
| *A61K 39/395* | (2006.01) | |
| *A61K 39/00* | (2006.01) | |

(52) U.S. Cl.
CPC .......... *C07K 16/18* (2013.01); *A61P 25/28* (2018.01); *C07K 14/4711* (2013.01); *C12N 15/62* (2013.01); *C12N 15/85* (2013.01); *A61K 39/3955* (2013.01); *A61K 2039/505* (2013.01); *C07K 2317/24* (2013.01); *C07K 2317/34* (2013.01); *C07K 2317/56* (2013.01); *C07K 2317/565* (2013.01); *C07K 2317/76* (2013.01); *C07K 2317/92* (2013.01); *C12N 2015/8518* (2013.01)

(58) Field of Classification Search
CPC ............... C07K 16/18; C07K 2317/24; C07K 2317/56; C07K 2317/565; C07K 2317/34; C07K 2317/76; A61K 39/3955; A61K 2039/505; A61P 25/28; C12N 15/62; C12N 15/85; C12N 2015/8518

See application file for complete search history.

(56) References Cited

U.S. PATENT DOCUMENTS

| | | | |
|---|---|---|---|
| 6,171,586 B1 | 1/2001 | Lam et al. | |
| 6,267,958 B1 | 7/2001 | Andya et al. | |
| 7,501,121 B2 * | 3/2009 | Tchistiakova | ........ C07K 16/244 424/139.1 |
| 7,871,607 B2 | 1/2011 | Bookbinder et al. | |
| 7,982,017 B2 * | 7/2011 | Lin | .................... C07K 16/2896 530/388.23 |
| 2006/0104968 A1 | 5/2006 | Bookbinder et al. | |
| 2013/0295021 A1 | 11/2013 | Chen et al. | |
| 2015/0252102 A1 | 9/2015 | Nitsch et al. | |
| 2015/0344553 A1 | 12/2015 | Weinreb et al. | |
| 2016/0183854 A1 | 6/2016 | Lee | |
| 2016/0251420 A1 | 9/2016 | Hayashi et al. | |
| 2016/0369005 A1 * | 12/2016 | Lippincott | ......... C07K 16/2827 |
| 2017/0026026 A1 | 1/2017 | Toyota | |
| 2017/0058024 A1 | 3/2017 | West et al. | |
| 2018/0037641 A1 | 2/2018 | Diamond et al. | |

FOREIGN PATENT DOCUMENTS

| | | |
|---|---|---|
| WO | 2006/044908 A2 | 4/2006 |
| WO | 2010/144711 A2 | 12/2010 |
| WO | 2012/045882 A2 | 4/2012 |
| WO | 2012/049570 A1 | 4/2012 |
| WO | 2012/125555 A1 | 9/2012 |
| WO | 2013/007839 A1 | 1/2013 |
| WO | 2013/041962 A1 | 3/2013 |
| WO | 2013/096380 A2 | 6/2013 |
| WO | 2013/151762 A1 | 10/2013 |
| WO | 2013/177104 A2 | 11/2013 |
| WO | 2013/180238 A1 | 12/2013 |
| WO | 2014/028777 A2 | 2/2014 |
| WO | 2014/059442 A2 | 4/2014 |

(Continued)

OTHER PUBLICATIONS

Goel M et al. Plasticity within the antigen-combining site may manifest as molecular mimicry in the humoral immune response. J. Immunol. 173:7358-7367. (Year: 2004).*

Kuby J, ed. Immunology, Third Edition, W.H. Freeman and Co., New York, pp. 131-134. (Year: 1997).*

Medina et al., "The role of extracellular Tau in the spreading of neurofibrillary pathology", Frontiers in Cellular Neuroscience, vol. 8, Article 113, Apr. 23, 2014, pp. 1-7.

Mead et al., "Halting of Caspase Activity Protects Tau from MC1-Conformational Changeand Aggregation", Journal of Alzheimer's Disease, 2016, vol. 54, pp. 1521-1538.

McMillan et al., "Tau Isoform Regulation Is Region- and Cell-Specific in Mouse Brain", The Journal of Comparative Neurology, vol. 511, No. 6, Dec. 20, 2008, pp. 788-803.

(Continued)

*Primary Examiner* — Kimberly Ballard
(74) *Attorney, Agent, or Firm* — BakerHostetler

(57) ABSTRACT

Provided herein are antibodies that specifically bind Tau and methods of using the same.

25 Claims, 67 Drawing Sheets

Specification includes a Sequence Listing.

(56) References Cited

FOREIGN PATENT DOCUMENTS

| WO | 2014/089104 | A1 | 6/2014 | | |
|---|---|---|---|---|---|
| WO | 2014/096321 | A1 | 6/2014 | | |
| WO | 2014/100600 | A2 | 6/2014 | | |
| WO | 2014/150877 | A2 | 9/2014 | | |
| WO | 2014/165271 | A2 | 10/2014 | | |
| WO | 2014/200921 | A1 | 12/2014 | | |
| WO | 2015/004163 | A1 | 1/2015 | | |
| WO | 2015/197735 | A1 | 12/2015 | | |
| WO | 2015/197820 | A1 | 12/2015 | | |
| WO | 2015/200806 | A2 | 12/2015 | | |
| WO | 2016/041553 | A2 | 3/2016 | | |
| WO | 2016/079597 | A1 | 5/2016 | | |
| WO | 2016/112078 | A2 | 7/2016 | | |
| WO | 2016/137811 | A1 | 9/2016 | | |
| WO | 2016/137950 | | 9/2016 | | |
| WO | 2017/005734 | A1 | 1/2017 | | |
| WO | 2017/009308 | A2 | 1/2017 | | |
| WO | WO-2017062496 | A2 | * | 4/2017 | ........... A61K 39/295 |
| WO | 2018/170351 | A1 | 9/2018 | | |

OTHER PUBLICATIONS

McEwan et al., "Cytosolic Fc receptor TRIM21 inhibits seeded tau aggregation", Proceedings of the National Academy of Sciences , Jan. 17, 2017, vol. 114, No. 3, pp. 574-579.

McAvoy et al., "Quantification of Tau in Cerebrospinal Fluid by Immunoaffinity Enrichment and Tandem Mass Spectrometry", Clinical Chemistry, vol. 60, 4, 2014, pp. 683-689.

Mandelkow, E., von Bergen, M., Biernat, J. and Mandelkow, E.M. (2007) Structural principles of tau and the paired helical filaments of Alzheimer's disease. Brain Pathol, 17, 83-90.

Mandelkow et al., "Biochemistry and Cell Biology of Tau Protein in Neurofibrillary Degeneration", Cold Spring Harbor Perspectives in Medicine, Jul. 2012, a006247.

Manassero et al., "Dual Mechanism of Toxicity for Extracellular Injection of Tau Oligomers versus Monomers in Human Tau Mice", Journal of Alzheimer's Disease, 2017, vol. 59, pp. 743-751.

Majerova et al., "Changes of Cerebrospinal Fluid Peptides due to Tauopathy", Journal of Alzheimer's Disease, vol. 58, 2017, pp. 507-520.

Magnoni et al., "Tau elevations in the brain extracellular space correlate with reduced amyloid-b levels and predict adverse clinical outcomes after severe traumatic brain injury", Brain a Journal of Neurology, vol. 135, Apr. 2012, pp. 1268-1280.

Maeda et al., "In Vivo Positron Emission Tomographic Imaging of Glial Responses to Amyloid-Beta and Tau Pathologies in Mouse Models of Alzheimer's Disease and Related Disorders", The Journal of Neuroscience, Mar. 23, 2011, vol. 31, No. 12, pp. 4720-4730.

Mably et al., "Tau immunization: a cautionary tale?", Neurobiology of Aging, vol. 36, No. 3, Mar. 2015, pp. 1316-1332.

Luo et al., "Microglial internalization and degradation of pathological tau is enhanced by an anti-tau monoclonal antibody", Scientific Reports, 2015, 5:11161.

Luna-Munoz et al., "Phosphorylation of Tau Protein Associated as a Protective Mechanism in the Presence of Toxic, C-Terminally Truncated Tau in Alzheimer's Disease", DOI: 10.5772/54228, 19 pages, 2013.

Lu et al., "Potential of the Antibody Against cis-Phosphorylated Tau in the Early Diagnosis, Treatment, and Prevention of Alzheimer Disease and Brain Injury", JAMA Neurology, vol. 73, No. 11, Nov. 2016, pp. 1356-1362.

Liu et al., "Vectored Intracerebral Immunization with the Anti-Tau Monoclonal Antibody PHF1 Markedly Reduces Tau Pathology in Mutant Tau Transgenic Mice", The Journal of Neuroscience, vol. 36, No. 49, Dec. 7, 2016, pp. 12425-12435.

Liu et al., "Dual vulnerability of tau to calpains and caspase-3 proteolysis under neurotoxic and neurodegenerative conditions", ASN NEURO, vol. 3, No. 1: e00051, 2010.

Lichtenberg-Kraag et al., "Phosphorylation-dependent epitopes of neurofilament antibodies on tau protein and relationship with Alzheimer tau", Proceedings of the National Academy of Sciences of the United States of America, vol. 89, Jun. 1992, pp. 5384-5388.

Li et al., Drug pipeline in neurodegeneration based on transgenic mice models of Alzheimer's disease, Ageing Research Reviews, vol. 12, 2013, pp. 116-140.

Li et al., "The neuritic plaque facilitates pathological conversion of tau in an Alzheimer's disease mouse model", Nature Communications, Jul. 4, 2016, 7:12082.

Li et al., "Frontotemporal Lobar Degeneration: Mechanisms and Therapeutic Strategies", Molecular Neurobiology, 2016, vol. 53, pp. 6091-6105.

Lewis et al., "Propagation of tau pathology: hypotheses, discoveries, and yet unresolved questions from experimental and human brain studies", Acta Neuropathol, vol. 131, 2016, pp. 27-48.

Levarska et al., "Of Rodents and Men: The Mysterious Interneuronal Pilgrimage of Misfolded Protein Tau in Alzheimer's Disease", Journal of Alzheimer's Disease, 2013, vol. 37, pp. 569-577.

Lee et al., "Bioanalytical Approaches to Quantify "Total" and "Free" Therapeutic Antibodies and Their Targets: Technical Challenges and PK/PD Applications Over the Course of Drug Development", The AAPS Journal, vol. 13, No. 1, Mar. 2011, pp. 99-110.

Lee et al., "Antibody-Mediated Targeting of Tau In Vivo Does Not Require Effector Function and Microglial Engagement", Cell Reports, vol. 16, No. 6, Aug. 9, 2016, pp. 1690-1700.

Lastres-Becker et al., "Fractalkine activates NRF2/NFE2L2 and heme oxygenase 1 to restrain tauopathy-induced microgliosis", Brain, vol. 137, 2014, pp. 78-91.

Lace et al., "Hippocampal tau pathology is related to neuroanatomical connections: an ageing population-based study", Brain, Mar. 24, 2009, pp. 1-11.

Kulic et al., "Active immunization trial in Abeta42-injected P301L tau transgenic mice", Neurobiology of Disease, vol. 22, 2006, pp. 50-56.

Kryndushkin et al., "Yeast [PSI+] prion aggregates are formed by small Sup35 polymers fragmented by Hsp104", The Journal of Biological Chemistry, vol. 278, No. 49, Dec. 5, 2003, pp. 49636-49643.

KrishnaKumar, V.G., Paul, A., Gazit, E. and Segal, D. (2018) Mechanistic insights into remodeled Tau-derived PHF6 peptide fibrils by Naphthoquinone-Tryptophan hybrids. Sci Rep, 8, 71.

Krestova et al., "Characterization of isolated tau-reactive antibodies from the IVIG product, plasma of patients with Alzheimer's disease and cognitively normal individuals", Journal of Neuroimmunology, vol. 313, 2017, pp. 16-24.

Koson et al., "Truncated tau expression levels determine life span of a rat model of tauopathy without causing neuronal loss or correlating with terminal neurofibrillary tangle load", European Journal of Neuroscience, vol. 28, No. 2, Jul. 2008, pp. 239-246.

Kontsekova, E., Zilka, N., Kovacech, B., Novak, P. and Novak, M. (2014) First-in-man tau vaccine targeting structural determinants essential for pathological tau-tau interaction reduces tau oligomerisation and neurofibrillary degeneration in an Alzheimer's disease model. Alzheimers Res Ther, 6, 44.

Kontsekova et al., "Identification of structural determinants on tau protein essential for its pathological function: novel therapeutic target for tau immunotherapy in Alzheimer's disease", Alzheimer's Research and Therapy, 2014, vol. 6, pp. 1-16.

Kontsekova et al., "Chaperone-Like Antibodies in Neurodegenerative Tauopathies: Implication for Immunotherapy", Cell Mol Neurobiol, vol. 29, 2009, pp. 793-798.

Kondo et al., "Antibody against early driver of neurodegeneration cis P-tau blocks brain injury and tauopathy", Nature, vol. 523, Jul. 23, 2015, pp. 431-436.

Kolarova et al., "Tau Oligomers in Sera of Patients with Alzheimer's Disease and Aged Controls", Journal of Alzheimer's Disease, vol. 58, No. 2, pp. 471-478, 2017.

Klafki et al., "Therapeutic approaches to Alzheimer's disease", Brain, 2006, pp. 1-16.

Kima et al., "New Insight into Alzheimer's Disease via Caspase 3-cleaved Tau: Pathogenic Role in Tau Oligomer Formation and Memory Deficits", Journal of Alzheimers Alzheimer's Disease & Parkinsonism, 2017, vol. 7, Issue 4, 4 pages.

(56) References Cited

OTHER PUBLICATIONS

Kim et al., "0-Glycosylation in Hinge Region of Mouse Immunoglobulin G2b", The Journal of Biological Chemistry, Apr. 22, 1994, vol. 269, No. 16, pp. pp. 12345-12350.
Kfoury et al., "Trans-cellular propagation of Tau aggregation by fibrillar species", J Biol Chem., vol. 287, No. 23, Jun. 1, 2012, pp. 19440-19451.
Kayed et al., "Tau Oligomers as Potential Drug Target for Alzheimer Disease (AD) Treatment", Intech Open Science Open Minds, pp. 635-647, 2011.
Kaufman et al., "Tau Prion Strains Dictate Patterns of Cell Pathology, Progression Rate, and Regional Vulnerability In Vivo", Neuron., vol. 92, No. 4, Nov. 23, 2016, pp. 796-812.
Karikari et al., "Expression and purification of tau protein and its frontotemporal dementia variants using a cleavable histidine tag", Protein Expression and Purification, 2017, vol. 130, pp. 44-54.
Karch et al., "Extracellular Tau Levels Are Influenced by Variability in Tau That Is Associated with Tauopathies", The Journal of Biological Chemistry, Dec. 14, 2012, vol. 287, No. 51, pp. 42751-42762.
Kanmert et al., "C-Terminally Truncated Forms of Tau, But Not Full-Length Tau or Its C-Terminal Fragments, Are Released fromNeurons Independently of Cell Death", The Journal of Neuroscience, Jul. 29, 2015, vol. 35, No. 30 pp. 10851-10865.
Kambe et al., "Differential regional distribution of phosphorylated tau and synapse loss in the nucleus accumbens in tauopathy model mice", Neurobiology of Disease, 2011, vol. 42, pp. 404-414.
Jucker et al., "Pathogenic Protein Seeding in Alzheimer Disease and Other Neurodegenerative Disorders", American Neurological Association, vol. 70, No. 4, Oct. 2011, pp. 532-540.
John Hardy, "Has the Amyloid Cascade Hypothesis for Alzheimer's Disease been Proved?", Current Alzheimer Research, vol. 3, 2006, pp. 71-73.
Jicha et al.,"Alz-50 and MC-1, a New Monoclonal Antibody Raised to Paired Helical Filaments, Recognize Conformational Epitopes on Recombinant Tau", Journal of Neuroscience Research vol. 48, No. 2, Apr. 15, 1997, pp. 128-132.
Rodriguez et al., "Tau Pathology Induces Excitatory Neuron Loss, Grid Cell Dysfunction, and Spatial Memory Deficits Reminiscent of Early Alzheimer's Disease", Neuron., vol. 93, No. 3, Feb. 8, 2017, pp. 533-541.
Roberson, et al., "100 Years and Counting: Prospects for Defeating Alzheimer's Disease", Science vol. 314, Nov. 3, 2006, pp. 781-784.
Rizzu et al., "Mutation-dependent aggregation of tau protein and its selectiv depletion from the soluble fraction in brain of P301L FTDP-17 patients", Human Molecular Genetics, 2000, vol. 9, No. 20, pp. 3075-3082.
Ren et al., Characteristics of tau oligomers, Frontiers in Neurology, vol. 4, Article 102, Jul. 2013, 6 pages.
Rao et al., "Specific Calpain Inhibition by Calpastatin Prevents Tauopathy and Neurodegeneration and Restores Normal Lifespan in Tau P301L Mice", The Journal of Neuroscience, vol. 34, No. 28, Jul. 9, 2014, pp. 9222-9234.
Rankin et al., "Pseudo-phosphorylation of tau at Ser202 and Thr205 affects tau filament formation", Molecular Brain Research, vol. 138, 2005, pp. 84-93.
Ramcharitar et al., "Cerebrospinal Fluid Tau Cleaved by Caspase-6 Reflects Brain Levels and Cognition in Aging and Alzheimer Disease", J Neuropathol Exp Neurol., Sep. 2013, vol. 72, No. 9, pp. 824-832.
Primio et al., "The Distance between N and C Termini of Tau and of FTDP-17 Mutants Is Modulated by Microtubule Interactions in Living Cells", Front Mol Neurosci., vol. 10, Article 210, Jun. 30, 2017, 13 pages.
Posada-Duque et al., "p35 and Rac1 underlie the neuroprotection and cognitive improvement induced by CDK5 silencing", Journal of Neurochemistry, vol. 134, 2015, pp. 354-370.
Portelius et al., "Characterization of Tau in Cerebrospinal Fluid Using Mass Spectrometry", The Journal of Proteome Research, 2008, vol. 7, pp. 2114-2120.

Pooler et al., "Propagation of tau pathology in Alzheimer's disease: identification of novel therapeutic targets", Alzheimer's Research & Therapy, vol. 5, 2013, pp. 1-8.
Pooler et al., "Physiological release of endogenous tau is stimulated by neuronal activity", European Molecular Biology Organization, vol. 14, No. 4, Apr. 2013, pp. 389-394.
Pooler et al., "A role for tau at the synapse in Alzheimer's disease pathogenesis", Neuropharmacology, vol. 76, 2014, pp. 1-8.
Polydoro et al., "Age-Dependent Impairment of Cognitive and Synaptic Function in the htau Mouse Model of Tau Pathology", The Journal of Neuroscience, vol. 29, No. 34, Aug. 26, 2009, pp. 10741-10749.
Piedrahita et al., "Silencing of CDK5 Reduces Neurofibrillary Tangles in Transgenic Alzheimer's Mice", The Journal of Neuroscience, vol. 30, No. 42, Oct. 20, 2010, pp. 13966-13976.
Petry et al., "Specificity of Anti-Tau Antibodies when Analyzing Mice Models of Alzheimer's Disease: Problems and Solutions", Plos One, vol. 9, Issue 5, May 2014, e94251.
Perez, M., Cuadros, R. and Medina, M. (2018) Tau Assembly into Filaments. Methods Mol Biol, 1779, 447-461.
Perez et al., "The FTDP-17-Linked Mutation R406W Abolishes the Interaction of Phosphorylated Tau with Microtubules", Journal of Neurochemistry, vol. 74, No. 6 , Jun. 2000, pp. 2583-2589.
Perez et al., "Secretion of full-length tau or tau fragments in a cell culture model", Neuroscience Letters, vol. 634, 2016, pp. 63-69.
Pedersen et al., "Tau immunotherapy for Alzheimer's disease", vol. 21, No. 6, Jun. 2015, pp. 394-402.
Patterson et al., "Characterization of Prefibrillar Tau Oligomers in Vitro and in Alzheimer Disease", The Journal of Biological Chemistry, Jul. 1, 2011, vol. 286, No. 26, pp. 23063-23076.
Pascual et al., "Immunological memory to hyperphosphorylated tau in asymptomatic individuals", Acta Neuropathol, 2017, vol. 133, pp. 767-783.
Park et al., "The generation of a 17 kDa neurotoxic fragment: an alternative mechanism by which tau mediates beta-amyloid-induced neurodegeneration", The Journal of Neuroscience, vol. 25, No. 22, Jun. 1, 2005, pp. 5365-5375.
Paholikova et al., "N-terminal Truncation of Microtubule Associated Protein Tau Dysregulates its Cellular Localization", Journal of Alzheimer's Disease, 2015, vol. 43, pp. 915-926.
Onishi et al., "Early-onset cognitive deficits and axonal transport dysfunction in P301S mutant tau transgenic mice", Neuroscience Research, 2014, vol. 80, pp. 76-85.
Okuda et al., "PE859, a novel tau aggregation inhibitor, reduces aggregated tau and prevents onset and progression of neural dysfunction in vivo", PLOS ONE, vol. 10, No. 2, Feb. 6, 2015, e0117511.
Oddo et al., "Temporal profile of amyloid-beta (Abeta) oligomerization in an in vivo model of Alzheimer disease. A link between Abeta and tau pathology", The Journal of Biological Chemistry, vol. 281, No. 3, Jan. 20, 2006, pp. 1599-1604.
Oddo et al., "Abeta Immunotherapy Leads to Clearance of Early, but Not Late, Hyperphosphorylated Tau Aggregates via the Proteasome", Neuron. vol. 43, No. 3, Aug. 5, 2004, pp. 321-332.
Novak, P., Kontsekova, E., Zilka, N. and Novak, M. (2018) Ten Years of Tau-Targeted Immunotherapy: The Path Walked and the Roads Ahead. Front Neurosci, 12, 798.
Novak et al., "Truncated Tau Triggers Tangles, Transmits Pathology", Alzheimer's disease, vol. 38, No. 3, 1994, pp. 173-189.
Novak et al., "Safety and immunogenicity of the tau vaccine AADvac1 in patients with Alzheimer's disease: a randomised, double-blind, placebo-controlled, phase 1 trial", The Lancet Neurology, vol. 16, Issue 2, 2017, pp. 123-134.
Novak et al., "Molecular characterization of the minimal protease resistant tau unit of the Alzheimer's disease paired helical filament", The EMBO Journal, 1993, vol. 12, No. 1 pp. 365-370.
Novak et al., "Difference between the tau protein of Alzheimer paired helical filament core and normal tau revealed by epitope analysis of monoclonal antibodies 423 and 7.51", Proceedings of the National Academy of Sciences, Jul. 1991, vol. 88, pp. 5837-5841.

(56) References Cited

OTHER PUBLICATIONS

Nobuhara et al., "Tau Antibody Targeting Pathological Species Blocks Neuronal Uptake and Interneuron Propagation of Tau in Vitro", The American Journal of Pathology, vol. 187, No. 6, Jun. 2017, pp. 1399-1412.

Nisbet et al., "Tau aggregation and its interplay with amyloid-Beta", Acta Neuropathol, vol. 129, 2015, pp. 207-220.

Niewidok et al., "Presence of a carboxy-terminal pseudorepeat and disease-like pseudohyperphosphorylation critically influence tau's interaction with microtubules in axon-like processes", Molecular Biology of the Cell, vol. 27, 2016, pp. 3537-3549.

Mukrasch, M.D., Biernat, J., von Bergen, M., Griesinger, C., Mandelkow, E. and Zweckstetter, M. (2005) Sites of tau important for aggregation populate {beta}-structure and bind to microtubules and polyanions. J Biol Chem, 280, 24978-24986.

Morozova et al., "Conformational Features of Tau Fibrils from Alzheimer's Disease Brain Are Faithfully Propagated by Unmodified Recombinant Protein", Biochemistry 2013, vol. 52, pp. 6960-6967.

Mohamed, T., Hoang, T., Jelokhani-Niaraki, M. and Rao, P.P. (2013) Tau-derived-hexapeptide 306VQIVYK311 aggregation inhibitors: nitrocatechol moiety as a pharmacophore in drug design. ACS Chem Neurosci, 4, 1559-1570.

Mohamed et al., "Spreading of tau pathology in Alzheimer's disease by cell-to-cell transmission", European Journal of Neuroscience, vol. 37, 2013, pp. 1939-1948.

Moe et al., "Drug development of inhibitors of tau oligomer formation for Alzheimer's disease and other tauopathies", Nov. 2018, 1 page.

Miyasaka et al., "Visualization of Newly Deposited tau in Neurofibrillary Tangles and Neuropil Threads", J Neuropathol Exp Neurol, vol. 64, No. 8 Aug. 2005, pp. 665-674.

Miyasaka et al., "Selective Deposition of Mutant Tau in the FTDP-17 Brain Affected by the P301L Mutation", Journal of Neuropathology and Experimental Nurology, vol. 60, No. 9, Sep. 2001, pp. 872-884.

Miyasaka et al., "Molecular Analysis of Mutant and Wild-Type Tau Deposited in the Brain Affected by the FTDP-17 R406W Mutation", American Journal of Pathology, Feb. 2001, vol. 158, No. 2, pp. 373-379.

Mirbaha, H., Chen, D., Morazova, O.A., Ruff, K.M., Sharma, A.M., Liu, X., Goodarzi, M., Pappu, R.V., Colby, D.W., Mirzaei, H. et al. (2018) Inert and seed-competent tau monomers suggest structural origins of aggregation. Elife, 7.

Mirbaha et al., "Tau Trimers Are the Minimal Propagation Unit Spontaneously Internalized to Seed Intracellular Aggregation", The Journal of Biological Chemistry, vol. 290, No. 24, Jun. 12, 2015, pp. 14893-14903.

Michel et al., "Extracellular Monomeric Tau Protein Is Sufficient to Initiate the Spread of Tau Protein Pathology", The Journal of Biological Chemistry, Jan. 10, 2014, vol. 289, No. 2, pp. 956-967.

Michael A Yassa, "Ground zero in alzheimer's disease", Nature Neuroscience, Feb. 2014, vol. 17, No. 2, pp. 146-147.

Meyer-Luehmann et al., "Exogenous Induction of Cerebral Beta-Amyloidogenesis Is Governed by Agent and Host", Science, vol. 313, Sep. 22, 2006, pp. 1781-1784.

Meredith Jr. et al., "Characterization of Novel CSF Tau and ptau Biomarkers for Alzheimer's Disease", PLOS ONE, vol. 8, Issue 10, e76523, 2013.

Wu et al, An analysis of the sequences of the variable regions of Bence Jones proteins and myeloma light chains and their implications for antibody complementarity, The Journal of experimental medicine, Aug. 1970;132(2):211-250.

Tiller et al., A fully synthetic human Fab antibody library based on fixed Vh/VK framework pairings with favorable biophysical properties, MAbs, May-Jun. 2013;5(3):445-470.

Spillantini et al., Tau pathology and neurodegeneration. The Lancet Neurology. Jun. 1, 2013;12(6):609-622.

Soeda et al., Toxic tau oligomer formation blocked by capping of cysteine residues with 1, 2-dihydroxybenzene groups, Nature communications, Dec. 16, 2015;6:10216.

Shammas et al., A mechanistic model of tau amyloid aggregation based on direct observation of oligomers, Nature communications, Apr. 30, 2015;6:7025.

Okayama et al., A cDNA cloning vector that permits expression of cDNA inserts in mammalian cells, Molecular and Cellular Biology, Feb. 1, 1983;3(2):280-289.

Lefranc et al, IMGT unique numbering for immunoglobulin and T cell receptor variable domains and Ig superfamily V-like domains, Developmental & Comparative Immunology, Jan. 1, 2003;27(1):55-77.

Karlin et al., Methods for assessing the statistical significance of molecular sequence features by using general scoring schemes, Proceedings of the National Academy of Sciences 87. Mar. 6, 1990: 2264-2268.

Karlin et al., Applications and statistics for multiple high-scoring segments in molecular sequences, Proceedings of the National Academy of Sciences 90(12) Jun. 1993: 5873-5877.

Kabat et al., Sequences of Proteins of Immunological Interest, 5th Edition, Public Health Service, National Institutes of Health, Bethesda, Md., 1991.

Jayaram et al., Germline Vh/VK pairing in antibodies. Protein Eng Des Sel. Oct. 2012;25(10):523-529.

Gadi et al., In vivo sensitization of ovarian tumors to chemotherapy by expression of *E coli* purine nucleoside phosphorylase in a small fraction of cells, Gene therapy, Oct. 2000;7(20):1738-1743.

Cline, Perspectives for gene therapy: inserting new genetic information into mammalian cells by physical techniques and viral vectors, Pharmacology & therapeutics, Jan. 1, 1985;29(1):69-92.

Brezinschek et al.,Pairing of variable heavy and variable kappa chains in individual naive and memory B cells, J Immunol, May 15, 1998;160(10):4762-4767.

Umeda et al., "Neurodegenerative Disorder FTDP-17-Related Tau Intron 10+16C—T Mutation Increases Tau Exon 10 Splicing and Causes Tauopathy in Transgenic Mice", The American Journal of Pathology, Jul. 2013, vol. 183, No. 1, pp. 211-225.

Tracy et al., "Acetylated Tau Obstructs KIBRA-Mediated Signaling in Synaptic Plasticity and Promotes Tauopathy-Related Memory Loss", neuroscience, vol. 90, No. 2, Apr. 20, 2016, pp. 245-260.

Todd E. Golde, "Disease modifying therapy for AD?", Journal of Neurochemistry, vol. 99, 2006, pp. 689-707.

Theunis et al., "Novel Phospho-Tau Monoclonal Antibody Generated Using a Liposomal Vaccine, with Enhanced Recognition of a Conformational Tauopathy Epitope", Journal of Alzheimer's Disease, 2017, vol. 56, pp. 585-599.

Theunis et al., "Efficacy and Safety of a Liposome-Based Vaccine against Protein Tau, Assessed in Tau.P301L Mice That Model Tauopathy", Plose One, vol. 8, No. 8, Aug. 2013, e72301.

Tarawneh et al., "Cerebrospinal Fluid Markers of Neurodegeneration and Rates of Brain Atrophy in Early Alzheimer Disease", JAMA Neurology, vol. 72, No. 6, Jun. 2015, pp. 656-665.

Taniguchi et al., "Transgenic mice expressing mutant (N279K) human tau show mutation dependent cognitive deficits without neurofibrillary tangle formation", FEBS Lett., vol. 579, No. 25, Oct. 24, 2005, pp. 5704-5712.

Taniguchi et al., "Inhibition of Heparin-induced Tau Filament Formation by Phenothiazines, Polyphenols, and Porphyrins", The Journal of Biological Chemistry, Mar. 4, 2005, vol. 280, No. 9, pp. 7614-7623.

Takeda et al., "Seed-competent *HMW tau* species accumulates in the cerebrospinal fluid of Alzheimer's disease mouse model and human patients", Annals of Neurology, vol. 80, 2016, pp. 355-367.

Takeda et al., "Neuronal uptake and propagation of a rare phosphorylated high-molecular-weight tau derived from Alzheimer's disease brain", Nature Communications, 2015, vol. 6: 8490.

Swanson et al., Extracellular Tau Oligomers Induce Invasion of Endogenous Tau into the Somatodendritic Compartment and Axonal Transport Dysfunction, Journal of Alzheimer's Disease, 2017, vol. 58, No. 3, pp. 803-820.

(56) References Cited

OTHER PUBLICATIONS

Sperber et al., "Glycogen synthase kinase-3Beta phosphorylates tau protein at multiple sites in intact cells", Neuroscience Letters, 1995, vol. 197, pp. 149-153.
Song et al., Effect of intraventricular infusion of anti-prion protein monoclonal antibodies on disease progression in prion-infected mice, Journal of General Virology, 2008, vol. 89, pp. 1533-1544.
Song et al., Analysis of tau post-translational modifications in rTg4510 mice, a model of tau pathology, Molecular Neurodegeneration, 2015, pp. 1-11.
Sokolow et al., "Pre-synaptic C-terminal truncated tau is released from cortical synapses in Alzheimer's disease", Journal of Neurochemistry, vol. 133, 2015, pp. 368-379.
Smit, F.X., Luiken, J.A. and Bolhuis, P.G. (2017) Primary Fibril Nucleation of Aggregation Prone Tau Fragments PHF6 and PHF6. J Phys Chem B, 121, 3250-3261.
Smet et al., "Accepting its Random Coil Nature Allows a Partial NMR Assignment of the Neuronal Tau Protein", Chembiochem. vol. 5, No. 12, pp. 1639-1646, 2004.
Skrabana et al., "Neuronal Expression of Truncated Tau Efficiently Promotes Neurodegeneration in Animal Models: Pitfalls of Toxic Oligomer Analysis", Journal of Alzheimer's Disease, 2017, vol. 58, pp. 1017-1025.
Skrabana et al., "Folding of Alzheimer's core PHF subunit revealed by monoclonal antibody 423", FEBS Letters, vol. 568, 2004, pp. 178-182.
Sierra et al., "Truncation of Tau Protein and its Pathological Significance in Alzheimer's Disease", Journal of Alzheimer's Disease, vol. 14, No. 4, Aug. 2008, pp. 401-409.
Shui et al., "Biosensors for Alzheimer's disease biomarker detection: A review", Biochimie 147, 2018, pp. 13-24.
Shimada et al., "Long-term oral lithium treatment attenuates motor disturbance in tauopathy model mice: Implications of autophagy promotion", Neurobiology of Disease, 2012, vol. 46, pp. 101-108.
Shiarli et al., "Comparison of extent of tau pathology in patients with frontotemporal dementia with Parkinsonism linked to chromosome 17 (FTDP-17), frontotemporal lobar degeneration with Pick bodies and early onset Alzheimer's disease", Neuropathology and Applied Neurobiology, 2006, vol. 32,pp. 374-387.
Shen et al., "Novel Cell- and Tissue-Based Assays for Detecting Misfolded and Aggregated Protein Accumulation Within Aggresomes and Inclusion Bodies", Cell Biochem Biophys, 2011, vol. 60, pp. 173-185.
Shahpasand et al., "Tau Immunotherapy: Hopes and Hindrances", Human Vaccines & Immunotherapeutics, vol. 14 , No. 2, Feb. 1, 2018, pp. 277-284.
Sevcik et al., "X-ray structure of the PHF core C-terminus: insight into the folding of the intrinsically disordered protein tau in Alzheimer's disease", FEBS Letters, vol. 581, No. 30, Dec. 22, 2007, pp. 5872-5878.
Serrano-Pozo et al., "Beneficial effect of human anti-amyloid-beta active immunization on neurite morphology and tau pathology", Brain : a journal of neurology, 2010, pp. 1-16.
Sengupta et al., "Tau oligomers in cerebrospinal fluid in Alzheimer's disease", Annals of Clinical and Translational Neurology, vol. 4, No. 4, Mar. 1, 2017, pp. 226-235.
Sengupta et al., "Degradation of Tau Protein by Puromycin-Sensitive Aminopeptidase in Vitro", Biochemistry, vol. 45, 2006, pp. 15111-15119.
Selenica et al., "Epitope analysis following active immunization with tau proteins reveals immunogens implicated in tau pathogenesis", Journal of Neuroinflammation 2014, 11:152.
Seidler, P.M., Boyer, D.R., Rodriguez, J.A., Sawaya, M.R., Cascio, D., Murray, K., Gonen, T. and Eisenberg, D.S. (2018) Structure-based inhibitors of tau aggregation. Nat Chem, 10, 170-176.
Schroeder et al., "Oligomeric tau-targeted immunotherapy in Tg4510 mice", Alzheimer's Research & Therapy, 2017, pp. 1-15.
Schroeder et al., " Tau-Directed Immunotherapy: A Promising Strategy for Treating Alzheimer's Disease and Other Tauopathies", J Neuroimmune Pharmacol, vol. 11, No. 1, Mar. 2016, pp. 9-25.

Schraen-Maschke et al., "Tau as a biomarker of neurodegenerative diseases", Biomark Med, vol. 2, No. 4, Aug. 2008, pp. 363-384.
Schneider et al., "Phosphorylation that Detaches Tau Protein from Microtubules (Ser262, Ser214) Also Protects It against Aggregation into Alzheimer Paired Helical Filaments", Biochemistry, vol. 38, No. 12, Mar. 23, 1999, pp. 3549-3558.
Schenk et al., "Current progress in beta-amyloid immunotherapy", Current Opinion in Immunology, vol. 16, Issue 5, Oct. 2004, pp. 599-606.
Sato et al., "Tau-tubulin kinase 1 (TTBK1), a neuron-specific tau kinase candidate, is involved in tau phosphorylation and aggregation", Journal of Neurochemistry, Sep. 2006, vol. 98, No. 5, pp. 1573-1584.
Sankaranarayanan et al., "Passive Immunization with Phospho-Tau Antibodies Reduces Tau Pathology and Functional Deficits in Two Distinct Mouse Tauopathy Models", Plos one, May 1, 2015, 28 pages.
Sang et al., "Phosphorylation of tau by glycogen synthase kinase 3Beta in intact mammalian cells influences the stability of microtubules", Neuroscience Letters, vol. 312, 2001, pp. 141-144.
Sanders et al., "Distinct Tau Prion Strains Propagate in Cells and Mice and Define Different Tauopathies", Neuron, vol. 82, Jun. 18, 2014, pp. 1271-1288.
Saito et al., "Early-onset, rapidly progressive familial tauopathy with R406W mutation", Neurology, vol. 58, 2002, pp. 811-813.
Sahara et el., "Tau oligomers as potential targets for early diagnosis of tauopathy", Journal of Alzheimer's Disease, 2014;40 Suppl 1:S91-6.
Sahara et al., "Phosphorylated p38MAPK specific antibodies cross-react with sarkosyl-insoluble hyperphosphorylated tau proteins", Journal of Neurochemistry, vol. 90, 2004, pp. 829-838.
Sahara et al., "Biochemical distribution of tau protein in synaptosomal fraction of transgenic mice expressing human P301L tau", Front Neurol., vol. 5, Article 26, Mar. 11, 2014, 8 pages.
Sahara et al., "Assembly of tau in transgenic animals expressing P301L tau: alteration of phosphorylation and solubility", Journal of Neurochemistry, vol. 83, No. 6, Dec. 2002, 1498-1508 pages.
Sabater et al., "Cellular investigations with human antibodies associated with the anti-IgLON5 syndrome", Journal of Neuroinflammation, vol. 13, 2016, pp. 1-12.
Sabater et al., "A novel non-rapid-eye movement and rapid-eye-movement parasomnia with sleep breathing disorder associated with antibodies to IgLON5: a case series, characterisation of the antigen, and post-mortem study", vol. 13, No. 6, Jun. 2014, pp. 575-586.
Russell et al., "Comprehensive Quantitative Profiling of Tau and Phosphorylated Tau Peptides in Cerebrospinal Fluid by Mass Spectrometry Provides New Biomarker Candidates", Journal of Alzheimer's Disease, 2017, vol. 55, pp. 303-313.
Rubenstein et al., "Comparing Plasma Phospho Tau, Total Tau, and Phospho Tau-Total Tau Ratio as Acute and Chronic Traumatic Brain Injury Biomarkers", JAMA Neurology, 2017, pp. E1-E11.
Rosenmann et al., "Asparagine endopeptidase cleaves tau and promotes neurodegeneration", Nature Medicine, vol. 20, No. 11, Nov. 2014, pp. 1236-1238.
Furman et al., "Widespread tau seeding activity at early Braak stages", Acta Neuropathol, vol. 133, No. 1, Jan. 2017, pp. 91-100.
Funk et al., "Distinct Therapeutic Mechanisms of Tau Antibodies Promoting Microglial Clearance Versus Blocking Neuronal Uptake", The Journal of Biological Chemistry vol. 290, No. 35, Aug. 28, 2015, pp. 21652-21662.
Fu et al., "3D Visualization of the Temporal and Spatial Spread of Tau Pathology Reveals Extensive Sites of Tau Accumulation Associated with Neuronal Loss and Recognition Memory Deficit in Aged Tau Transgenic Mice" PLoS ONE 11(7): e0159463, 2016.
Frost et al., "Propagation of Tau Misfolding from the Outside to the Inside of a Cell", The Journal of Biological Chemistry vol. 284, No. 19, May 8, 2009, pp. 12845-12852.
Friedhoff, P., von Bergen, M., Mandelkow, E.M. and Mandelkow, E. (2000) Structure of tau protein and assembly into paired helical filaments. Biochim Biophys Acta, 1502, 122-132.
Frenkel-Pinter, M., Tal, S., Scherzer-Attali, R., Abu-Hussien, M., Alyagor, I., Eisenbaum, T., Gazit, E. and Segal, D. (2016)

(56) References Cited

OTHER PUBLICATIONS

Naphthoquinone-Tryptophan Hybrid Inhibits Aggregation of the Tau-Derived Peptide PHF6 and Reduces Neurotoxicity. J Alzheimers Dis, 51, 165-178.

Frederick et al., "Rapamycin Ester Analog CCI-779/Temsirolimus Alleviates Tau Pathology and Improves Motor Deficit in Mutant Tau Transgenic Mice", Journal of Alzheimer's Disease, vol. 44, 2015, pp. 1145-1156.

Foulds et al., "Plasma phosphorylated-TDP-43 protein levels correlate with brain pathology in frontotemporal lobar degeneration", Acta Neuropathol, 2009, pp. 647-658.

Fitzpatrick, A.W.P., Falcon, B., He, S., Murzin, A.G., Murshudov, G., Garringer, H.J., Crowther, R.A., Ghetti, B., Goedert, M. and Scheres, S.H.W. (2017) Cryo-EM structures of tau filaments from Alzheimer's disease. Nature, 547, 185-190.

Filipcik et al., "First transgenic rat model developing progressive cortical neurofibrillary tangles", Neurobiology of Aging, 2012, vol. 33, pp. 1448-1456.

Falcon et al., "Conformation Determines the Seeding Potencies of Native and Recombinant Tau Aggregates", The Journal of Biological Chemistry, Jan. 9, 2015, vol. 290, No. 2, pp. 1049-1065.

F. Grüninger, "Invited review: Drug development for tauopathies", Neuropathology and Applied Neurobiology, 2015, vol. 41, pp. 81-96.

Esteves-Villanueva et al., "Effects of Tau Domain-Specific Antibodies and Intravenous Immunoglobulin on Tau Aggregation and Aggregate Degradation", Biochemistry, 2015, vol. 54, pp. 293-302.

Eschmann, N.A., Georgieva, E.R., Ganguly, P., Borbat, P.P., Rappaport, M.D., Akdogan, Y., Freed, J.H., Shea, J.E. and Han, S. (2017) Signature of an aggregation-prone conformation of tau. Sci Rep, 7, 44739.

Dujardin et al., "Neuron-to-neuron wild-type Tau protein transfer through a trans-synaptic mechanism: relevance to sporadic tauopathies", Acta Neuropathologica Communications, 2014, pp. 1-14.

Dujardin et al., "Ectosomes: A New Mechanism for Non-Exosomal Secretion of Tau Protein", PLOS ONE, Jun. 2014, vol. 9, Issue 6, e100760.

Duff et al., "Characterization of Pathology in Transgenic Mice Over-Expressing Human Genomic and cDNA Tau Transgenes", Neurobiology of Disease, 2000, vol. 7, pp. 87-98.

Duara et al., "The basis for disease-modifying treatments for Alzheimer's disease: The Sixth Annual Mild Cognitive Impairment Symposium", Alzheimer's & Dementia, vol. 5, 2009, pp. 66-74.

Doody et al., "Phase 3 Trials of Solanezumab for Mild-to-Moderate Alzheimer's Disease", The New England Journal of Medicine, vol. 370, Jan. 23, 2014, pp. 311-321.

Dickey et al., "Aging Analysis Reveals Slowed Tau Turnover and Enhanced Stress Response in a Mouse Model of Tauopathy", The American Journal of Pathology, vol. 174, No. 1, Jan. 2009, pp. 228-238.

Derisbourg et al., "Role of the Tau N-terminal region in microtubule stabilization revealed by new endogenous truncated forms", Scientific Reports, vol. 5, 2015, 10 pages.

Delobel et al., "Analysis of Tau Phosphorylation and Truncation in a Mouse Model of Human Tauopathy", The American Journal of Pathology, vol. 172, No. 1, Jan. 2008, pp. 123-131.

Day et al., Caspase-Cleaved Tau Co-Localizes with Early Tangle Markers in the Human Vascular Dementia Brain, PLOS ONE, 2015, vol. 10, No. 7 : e0132637.

Dai et al., "Passive immunization targeting the N-terminal projection domain of tau decreases tau pathology and improves cognition in a transgenic mouse model of Alzheimer disease and tauopathies", J Neural Transm (Vienna)., vol. 122, No. 4, Apr. 2015, pp. 607-617.

D'Abramo, "Passive Immunization in JNPL3 Transgenic Mice Using an Array of Phospho-Tau Specific Antibodies" Plos One, vol. 10, No. 8, 2015, e0135774.

D'Abramo et al., "Detecting tau in serum of transgenic animal models after tau immunotherapy treatment", Neurobiology of Aging, vol. 37, Jan. 2016, pp. 58-65.

Csokova et al., Rapid purification of truncated tau proteins: model approach to purification of functionally active fragments of disordered proteins, implication for neurodegenerative diseases, Protein Expression and Purification, vol. 35, 2004, pp. 366-372.

Croft et al., "Membrane association and release of wild-type and pathological tau from organotypic brain slice cultures", Cell Death and Disease, 2017, vol. 8, e2671.

Courade, J.P., Angers, R., Mairet-Coello, G., Pacico, N., Tyson, K., Lightwood, D., Munro, R., McMillan, D., Griffin, R., Baker, T. et al. (2018) Epitope determines efficacy of therapeutic anti-Tau antibodies in a functional assay with human Alzheimer Tau. Acta Neuropathol, 136, 729-745.

Cotman et al., "The role of caspase cleavage of tau in Alzheimer disease neuropathology", J Neuropathol Exp Neurol, vol. 64, No. 2, Feb. 2005, pp. 104-112.

Congdon et al., "Affinity of Tau antibodies for solubilized pathological Tau species but not their immunogen or insoluble Tau aggregates predicts in vivo and ex vivo efficacy", Molecular Neurodegeneration, vol. 11, No. 1, Aug. 30, 2016, 24 pages.

Collin et al., "Neuronal uptake of tau/pS422 antibody and reduced progression of tau pathology in a mouse model of Alzheimer's disease", Brain, 2014, vol. 137, pp. 2834-2846.

Cohen et al., "Intrinsic Tau Acetylation Is Coupled to Auto-Proteolytic Tau Fragmentation", PLOS ONE, 2016, vol. 11, No. 7, e0158470.

Clavaguera et al., "Intercellular transfer of tau aggregates and spreading of tau pathology: Implications for therapeutic strategies", Neuropharmacology, vol. 76, 2014, pp. 9-15.

Clavaguera et al., "Brain homogenates from human tauopathies induce tau inclusions in mouse brain", Proceedings of the National Academy of Sciences, vol. 110, No. 23, Jun. 4, 2013, pp. 9535-9540.

Citron, "Alzheimer's disease: strategies for disease modification", Nature Reviews Drug Discovery, vol. 9, May 2010, pp. 387-398.

Cho et al., "Glycogen synthase kinase 3beta phosphorylates tau at both primed and unprimed sites", Differential impact on microtubule binding, The Journal of Biological Chemistry, vol. 278, No. 1, Issue of Jan. 3, 2003, pp. 187-193.

Chesser et al., "Tau clearance mechanisms and their possible role in the pathogenesis of Alzheimer disease", FrontiersinNeurology Neurodegeneration, Sep. 3, 2013, vol. 4, Article 122.

Chai et al., "Passive Immunization with Anti-Tau Antibodies in Two Transgenic Models", Reduction of Tau Pathology and Delay of Disease Progression, The Journal of Biological Chemistry vol. 286, No. 39, Sep. 30, 2011, pp. 34457-34467.

Castillo-Carranza et al., "Specific Targeting of Tau Oligomers in Htau Mice Prevents Cognitive Impairment and Tau Toxicity Following Injection with Brain-Derived Tau Oligomeric Seeds", Journal of Alzheimer's Disease, vol. 40, 2014, pp. S97-S111.

Carranza et al., "Passive immunization with Tau oligomer monoclonal antibody reverses tauopathy phenotypes without affecting hyperphosphorylated neurofibrillary tangles", The Journal of Neuroscience, vol. 34, No. 12, Mar. 19, 2014, pp. 4260-4272.

Capsoni et al., "Alzheimer-like neurodegeneration in aged antinerve growth factor transgenic mice", Proceedings of the National Academy of Sciences, vol. 97, No. 12, Jun. 6, 2000, pp. 6826-6831.

Canu et al., "Tau Cleavage and Dephosphorylation in Cerebellar Granule Neurons Undergoing Apoptosis", The Journal of Neuroscience, vol. 18, No. 18, Sep. 15, 1998, pp. 7061-7074.

Calignon et al., "Propagation of Tau Pathology in a Model of Early Alzheimer's Disease", Neuron, vol. 73, Feb. 23, 2012, pp. 685-697.

Bruch et al., "PERK activation mitigates tau pathology in vitro and in vivo", EMBO Molecular Medicine, vol. 9, No. 3, Mar. 2017, pp. 371-384.

Bros et al., "Antibody-free quantification of seven tau peptides in human CSF using targeted mass spectrometry", frontiers in Neuroscience, vol. 9, Article 302, Sep. 2015, 8 pages.

Bright et al., "Human secreted tau increases amyloid-beta production", Neurobiology of Aging, 2015, vol. 36, pp. 693-709.

Brettschneider et al., "Spreading of pathology in neurodegenerative diseases: focus on human studies", Nature Reviews, Neuroscience, vol. 16, Feb. 2015, pp. 109-120.

(56) References Cited

OTHER PUBLICATIONS

Boutajangout et al., "Passive immunization targeting pathological phospho-tau protein in a mouse model reduces functional decline and clears tau aggregates from the brain", J Neurochem., vol. 118, No. 4, Aug. 2011, pp. 658-667.

Boutajangout et al., "Immunotherapy Targeting Pathological Tau Prevents Cognitive Decline in a New Tangle Mouse Model", The Journal of Neuroscience, Dec. 8, 2010, vol. 30, No. 49, pp. 16559-16566.

Borrok et al., "pH-dependent binding engineering reveals an FcRn affinity threshold that governs IgG recycling", The Journal of Biological Chemistry, vol. 290, No. 7, Feb. 13, 2015, pp. 4282-4290.

Bongaarts et al., "Tau truncation during neurofibrillary tangle evolution in Alzheimer's disease", Neurobiology of Aging, vol. 26, No. 7, Jul. 2005, pp. 1015-1022.

Bondareff et al., "Molecular Analysis of Neurofibrillary Degeneration in Alzheimer's Disease, An Immunohistochemical Study", AmericanJournal ofPathology, Sep. 1990, vol. 137, No. 3, pp. 711-723.

Boluda et al., "Differential induction and spread of tau pathology in young PS19 tau transgenic mice following intracerebral injections of pathological tau from Alzheimer's disease or corticobasal degeneration brains", Acta Neuropathol 2015, vol. 129, pp. 221-237.

Boimel et al., "Efficacy and safety of immunization with phosphorylated tau against neurofibrillary tangles in mice", Experimental Neurology, vol. 224, 2010, pp. 472-485.

Blennow et al., "Understanding biomarkers of neurodegeneration: Ultrasensitive detection techniques pave the way for mechanistic understanding", Nature Medicine, vol. 21, No. 3, Mar. 2015, pp. 217-219.

Bijari, N., Balalaie, S., Akbari, V., Golmohammadi, F., Moradi, S., Adibi, H. and Khodarahmi, R. (2018) Effective suppression of the modified PHF6 peptide/1N4R Tau amyloid aggregation by intact curcumin, not its degradation products: Another evidence for the pigment as preventive/therapeutic "functional food". Int J Biol Macromol, 120, 1009-1022.

Biernat et al., "The switch of tau protein to an Alzheimer-like state includes the phosphorylation of two serine-proline motifs upstream of the microtubule binding region", The EMBO Journal, vol. 11, No. 4, 1992, pp. 1593-1597.

Bi et al., "Tau-Targeted Immunization Impedes Progression of Neurofibrillary Histopathology in Aged P301L Tau Transgenic Mice", Plos One, vol. 6, Issue 12, Dec. 2011, e26860.

Bebber et al., "Methylene blue fails to inhibit Tau and polyglutamine protein-dependent toxicity in zebrafish", Neurobiology of Disease, 2010, vol. 39, Issue 3, pp. 265-271.

Barthelemy et al., "Tau Protein Quantification in Human Cerebrospinal Fluid by Targeted Mass Spectrometry at High Sequence Coverage Provides Insights into Its Primary Structure Heterogeneity", Journal of Proteome Research, vol. 15, No. 2, Feb. 5, 2016, pp. 667-676.

Barthelemy et al., "Differential Mass Spectrometry Profiles of Tau Protein in the Cerebrospinal Fluid of Patients with Alzheimer's Disease, Progressive Supranuclear Palsy, and Dementia with Lewy Bodies", Journal of Alzheimer's Disease, 2016, vol. 51, pp. 1033-1043.

Barten et al., "Tau Transgenic Mice as Models for Cerebrospinal Fluid Tau Biomarkers", Journal of Alzheimer's Disease, vol. 24, No. 2, 2011, pp. 127-141.

Barghorn et al., "Tau paired helical filaments from Alzheimer's disease brain and assembled in vitro are based on beta-structure in the core domain", Biochemistry, vol. 43, No. 6, Feb. 17, 2004, 1694-1703.

Baker et al., "Immunogenicity of protein therapeutics: The key causes, consequences and challenges", Self/Nonself, 2010, vol. 1, Issue 4, pp. 314-322.

Baker et al., "Extracellular Vesicles Containing P301L Mutant Tau Accelerate Pathological Tau Phosphorylation and Oligomer Formation but Do Not Seed Mature Neurofibrillary Tangles in ALZ17 Mice", Journal of Alzheimer's Disease, 2016, vol. 54, pp. 1207-1217.

Bacioglu et al., "Neurofilament Light Chain in Blood and CSF as Marker of Disease Progression in Mouse Models and in Neurodegenerative Diseases", Neuron, 2016, vol. 91, pp. 56-66.

Augustinack et al., "Specific tau phosphorylation sites correlate with severity of neuronal cytopathology in Alzheimer's disease", Acta Neuropathol, vol. 103, No. 1, 2002, pp. 26-35.

Audouard et al., "High-Molecular-Weight Paired Helical Filaments from Alzheimer Brain Induces Seeding of Wild-Type Mouse Tau into an Argyrophilic 4R Tau Pathology in Vivo", The American Journal of Pathology, Oct. 2016, vol. 186, No. 10, pp. 2709-2722.

Asuni et al., "Immunotherapy Targeting Pathological Tau Conformers in a Tangle Mouse Model Reduces Brain Pathology with Associated Functional Improvements", The Journal of Neuroscience, Aug. 22, 2007, vol. 27, No. 34, pp. 9115-9129.

Aslund et al., "Novel Pentameric Thiophene Derivatives for in Vitro and in Vivo Optical Imaging of a Plethora of Protein Aggregates in Cerebral Amyloidoses", ACS Chemical Biology, 2009, vol. 4, pp. 673-684.

Arai et al., "Different immunoreactivities of the microtubule-binding region of tau and its molecular basis in brains from patients with Alzheimer's disease, Pick's disease, progressive supranuclear palsy and corticobasal degeneration", Acta Neuropathol, 2003, vol. 105, pp. 489-498.

Andorfer et al., "Hyperphosphorylation and aggregation of tau in mice expressing normal human tau isoforms", Journal of Neurochemistry, 2003, vol. 86, pp. 582-590.

Allen et al., "Abundant Tau Filaments and Nonapoptotic Neurodegeneration in Transgenic Mice Expressing Human P301S Tau Protein", The Journal of Neuroscience, vol. 22, No. 21, Nov. 1, 2002, pp. 9340-9351.

Ahmed et al., "A novel in vivo model of tau propagation with rapid and progressive neurofibrillary tangle pathology: the pattern of spread is determined by connectivity, not proximity", Acta Neuropathol. vol. 127, No. 5, May 2014, pp. 687-683.

Agadjanyan et al., "Humanized monoclonal antibody armanezumab specific to N-terminus of pathological tau: characterization and therapeutic potency", Molecular Neurodegeneration, 2017, 12:33.

Abramo et al., "Tau passive immunotherapy in mutant P301L mice: antibody affinity versus specificity", PLoS One, vol. 8, No. 4, Apr. 29, 2013, e62402.

"AC Immune to receive milestone payment for Anti-Tau Antibody moving into Phase 1 trial for Alzheimer's disease", 3 pages, 2016.

Vingtdeux et al., "Potential contribution of exosomes to the prion-like propagation of lesions in Alzheimer's disease", Frontiers in Physiology, vol. 3, Jul. 5, 2012, p. 1-16.

Jennifer A. Kearney, "Less is More: Reducing Tau Ameliorates Seizures in Epilepsy Models", Epilepsy Currents, 2013, vol. 13, No. 4, pp. 184-185.

Janelidze et al., "Cerebrospinal fluid neurogranin and YKL-40 as biomarkers of Alzheimer's disease", Annals of Clinical and Translational Neurology, vol. 3, No. 1, 2016, pp. 12-20.

Jakes et al., "Identification of 3- and 4-repeat tau isoforms within the PHF in Alzheimer's disease", The EMBO Journal, 1991, vol. 10, No. 10, pp. 2725-2729.

Jadhav et al., "Truncated tau deregulates synaptic markers in rat model for human tauopathy", Front Cell Neurosci., vol. 9, Article 24, Feb. 2015, 14 pages.

Jackson et al., "Short Fibrils Constitute the Major Species of Seed-Competent Tau in the Brains of Mice Transgenic for Human P301S Tau", The Journal of Neuroscience, vol. 36, No. 3, Jan. 20, 2016, pp. 762-772.

Ittner et al., "Tau-targeting passive immunization modulates aspects of pathology in tau transgenic mice", International Society for Neurochemistry, J. Neurochem., vol. 132, No. 1, Jan. 2015, pp. 135-145.

Ishiki et al., "Longitudinal Assessment of Tau Pathology in Patients with Alzheimer's Disease Using [18F] THK-5117 Positron Emission Tomography", PLOS ONE, 2015, vol. 10, No. 10, e0140311.

(56) References Cited

OTHER PUBLICATIONS

Ishiguro et al., "Phosphorylation sites on tau by tau protein kinase I, a bovine derived kinase generating an epitope of paired helical filaments", Neuroscience Letters, vol. 148, 1992, pp. 202-206.
Iqbal et al., "Tau and neurodegenerative disease: the story so far", Nature Reviews Neurology, vol. 12, Jan. 2016, pp. 15-27.
Inouye, H., Sharma, D., Goux, W.J. and Kirschner, D.A. (2006) Structure of core domain of fibril-forming PHF/Tau fragments. Biophys J, 90, 1774-1789.
Iba et al., Synthetic Tau Fibrils Mediate Transmission of Neurofibrillary Tangles in a Transgenic Mouse Model of Alzheimer's-Like Tauopathy, The Journal of Neuroscience, vol. 33, No. 3, Jan. 16, 2013, pp. 1024-1037.
Hyman et al., "Tau Propagation, Different Tau Phenotypes, and Prion-like Properties of Tau", Neuron., vol. 18, No. 6, Jun. 18, 2014, pp. 1189-1190.
Huang et al., "Probing Conformational Dynamics of Tau Protein by Hydrogen/Deuterium Exchange Mass Spectrometry", Journal of the American Society for Mass Spectrometry, vol. 29, 2018, pp. 174-182.
Hu et al., "Identification of Novel Small-Molecule Tau Aggregation Inhibitors for Treatment of Tauopathies", Alzheimer's and Dementia 2014, p. P866.
HTau.P301S, Alzforum, Research Models, pp. 1-5, /www.alzforum.org/research-models/htaup301s, website access on Dec. 5, 2018.
Hosokawa et al., "Methylene Blue Reduced Abnormal Tau Accumulation in P301L Tau Transgenic Mice", PLOS ONE, Dec. 2012, vol. 7, Issue 12, e52389.
Hoshino et al., "Emergence of Immunoreactivities for phosphorylated tau and amyloid-Beta protein in chronic stage of fluid percussion injury in rat brain", NeuroReport 1998, vol. 9, pp. 1879-1883.
Holton et al., "Regional Distribution of Amyloid-Bri Deposition and Its Association with Neurofibrillary Degeneration in Familial British Dementia", American Journal of Pathology, vol. 158, No. 2, Feb. 2001, pp. 515-526.
Holmes et al., "Proteopathic tau seeding predicts tauopathy in vivo", Proceedings of the National Academy of Sciences, vol. 111, No. 41, 2014, pp. E4376-E4385.
Holmes et al., "Prion-like Properties of Tau Protein: The Importance of Extracellular Tau as a Therapeutic Target", The Journal of Biological Chemistry, vol. 289, No. 29, Jul. 18, 2014, pp. 19855-19861.
Holmes et al., "Heparan sulfate proteoglycans mediate internalization and propagation of specific proteopathic seeds", Proceedings of the National Academy of Sciences, 2013, vol. 110, pp. E3138-E3147.
Hogg et al., "The L266V tau mutation is associated with frontotemporal dementia and Pick-like 3R and 4R tauopathy", Acta Neuropathol, vol. 106, No. 4, Oct. 2003, pp. 323-336.
Henriksen et al., An Enzyme-Generated Fragment of Tau Measured in Serum Shows an Inverse Correlation to Cognitive Function PLoS One, vol. 8, No. 5, May 22, 2013, e64990.
Hellwig et al., "Neurogranin and YKL-40: independent markers of synaptic degeneration and neuroinflammation in Alzheimer's disease", Alzheimer's Research & Therapy, 2015, pp. 1-8.
Hasegawa et al., "Characterization of mAb AP422, a novel phosphorylation-dependent monoclonal antibody against tau protein", FEBS Letters, vol. 384, 1996, pp. 25-30.
Hasegawa et al., "3R and 4R tau isoforms in paired helical filaments in Alzheimer's", Acta Neuropathol vol. 127, No. 2, 2014, pp. 303-305.
Harrington et al., "Cellular Models of Aggregation-dependent Template-directed Proteolysis to Characterize Tau Aggregation Inhibitors for Treatment of Alzheimer Disease", The Journal of Biological Chemistry, 2015, vol. 290, No. 17, pp. 10862-10875.
Hans Kretzschmar, "Brain banking: opportunities, challenges and meaning for the future", Nature Reviews Neuroscience, vol. 10, Jan. 2009, pp. 70-78.
Hanger et al., "Tau cleavage and tau aggregation in neurodegenerative disease", Biochemical Society Transactions, vol. 38, Aug. 2010, pp. 1016-1020.
Guo et al., "Unique pathological tau conformers from Alzheimer's brains transmit tau pathology in nontransgenic mice", J Exp Med., vol. 213, No. 12, Nov. 14, 2016, pp. 2635-2654.
Guo et al., "Roles of tau protein in health and disease", Acta Neuropathol, vol. 133, 2017, pp. 665-704.
Guo et al., "Modeling Alzheimer's Disease in Mouse without Mutant Protein Overexpression: Cooperative and Independent Effects of Abeta and Tau", PLOS ONE, Nov. 2013, vol. 8, Issue 11, e80706.
Guo et al., "Cell-to-cell transmission of pathogenic proteins in neurodegenerative diseases", Nature Medicine, vol. 20, No. 2, Feb. 2014, pp. 130-138.
Guo et al., "Amyloid-Beta plaques enhance Alzheimer's brain tau-seeded pathologies by facilitating neuritic plaque tau aggregation", Nature Medicine vol. 24, No. 1, Jan. 2018, pp. 29-38.
Guerrero et al., "Hyperphosphorylated tau aggregates in the cortex and hippocampus of transgenic mice with mutant human FTDP-17 Tau and lacking the PARK2 gene", Acta Neuropathol, 2009, vol. 117, pp. 159-168.
Gu et al., "Two Novel Tau Antibodies Targeting the 396/404 Region Are Primarily Taken Up by Neurons and Reduce Tau Protein Pathology", The Journal of Biological Chemistry, vol. 288, No. 46, Nov. 15, 2013, pp. 33081-33095.
Gotz et al., "Transgenic animal models of Alzheimer's disease and related disorders: histopathology, behavior and therapy", Molecular Psychiatry, vol. 9, 2004, pp. 664-683.
Gotz et al., "Formation of Neurofibrillary Tangles in P301L Tau Transgenic Mice Induced by Abeta 42 Fibrils", Science, vol. 293, Aug. 24, 2001, pp. 1491-1495.
Gomez-Ramos et al., "Expression of an altered form of tau in Sf9 insect cells results in the assembly of polymers resembling Alzheimer's paired helical filaments", Brain Research, 2004, vol. 1007, pp. 57-64.
Golde et al., "Anti-Tau Antibodies: Hitting the Target", Neuroscience vol. 80, No. 2, Oct. 16, 2013, pp. 254-256.
Goedert et al., "Epitope mapping of monoclonal antibodies to the paired helical filaments of Alzheimer's disease: identification of phosphorylation sites in tau protein", Biochemical Journal, 1994, vol. 301, pp. 871-877.
Gerson et al., "Formation and propagation of tau oligomeric seeds", Frontiers Neurology, Jul. 2013, vol. 4, Article 93.
Gerard Drewes, "MARKing tau for tangles and toxicity", TRENDS in Biochemical Sciences, Oct. 2004, vol. 29, No. 10, pp. 548-555.
Gelpi et al., "Neuropathological criteria of anti-IgLON5-related tauopathy", Acta Neuropathol, 2016, vol. 132, pp. 531-543.
Garringer et al., "Increased Tau Phosphorylation and Tau Truncation, and Decreased Synaptophysin Levels in Mutant BRI2/TauTransgenic Mice", PLOS ONE, Feb. 2013, vol. 8, Issue 2, e56426.
Garg et al., "Cleavage of Tau by calpain in Alzheimer's disease: the quest for the toxic 17 kD fragment", Neurobiology of Aging, 2011, vol. 32, pp. 1-14.
Ganguly, P., Do, T.D., Larini, L., LaPointe, N.E., Sercel, A.J., Shade, M.F., Feinstein, S.C., Bowers, M.T. and Shea, J.E. (2015) Tau assembly: the dominant role of PHF6 (VQIVYK) in microtubule binding region repeat R3. J Phys Chem B, 119, 4582-4593.
Gamir-Morralla et al., "Kidins220 Correlates with Tau in Alzheimer's Disease Brain and Cerebrospinal Fluid", Journal of Alzheimers Disease, 2017, vol. 55, pp. 1327-1333.
Games et al., "Reducing C-Terminal-Truncated Alpha-Synuclein by Immunotherapy Attenuates Neurodegeneration and Propagation in Parkinson's Disease-Like Models", The Journal of Neuroscience, vol. 34, No. 28, Jul. 9, 2014, pp. 9441-9454.
Games et al., "Mice as models: Transgenic approaches and Alzheimer's disease", Journal of Alzheimer's Disease, vol. 9, 2006, pp. 133-149.
Zimova et al., "Human Truncated Tau Induces Mature Neurofibrillary Pathology in a Mouse Model of Human Tauopathy", Journal of Alzheimer's Disease, 2016, vol. 54, pp. 831-843.

(56) References Cited

OTHER PUBLICATIONS

Zilkova et al., "Hyperphosphorylated Truncated Protein Tau Induces Caspase-3 Independent Apoptosis-Like Pathway in the Alzheimer's Disease Cellular Model", Journal of Alzheimer's Disease, 2011, vol. 23, pp. 161-169.

Zilka et al., "Truncated tau from sporadic Alzheimer's disease suffices to drive neurofibrillary degeneration in vivo", FEBS Lett., vol. 580, No. 15, Jun. 26, 2006, pp. 3582-3588.

Zilka et al., "The self-perpetuating tau truncation circle", Biochem. Soc. Trans., vol. 40, No. 4, Aug. 2012, pp. 681-686.

Zheng-Fischhofer et al., "Sequential phosphorylation of Tau by glycogen synthase kinase-3Beta and protein kinase A at Thr212 and Ser214 generates the Alzheimer-specific epitope of antibody AT100 and requires a paired-helical-filament-like conformation", European Journal of Biochemistry, Vlume, 252, 1998, pp. 542-552.

Zheng, J., Baghkhanian, A.M. and Nowick, J.S. (2013) A hydrophobic surface is essential to inhibit the aggregation of a tau-protein-derived hexapeptide. J Am Chem Soc, 135, 6846-6852.

Zhao et al., "Caspase-2 cleavage of tau reversibly impairs memory", Nature Medicine, Nov. 2016, vol. 22, No. 11, pp. 1268-1276.

Zhao et al., "Appoptosin-Mediated Caspase Cleavage of Tau Contributes to Progressive Supranuclear Palsy Pathogenesis", Neuron. vol. 87, No. 5, Sep. 2, 2015, pp. 963-975.

Zhang et al., "Hyperphosphorylation determines both the spread and the morphology of tau pathology", Alzheimer's & Dementia, 2016, vol. 12, pp. 1066-1077.

Zhang et al., "CXCL1 Triggers Caspase-3 Dependent Tau Cleavage in Long-Term Neuronal Cultures and in the Hippocampus of Aged Mice: Implications in Alzheimer's Disease", Journal of Alzheimer's Disease, vol. 48, 2015, pp. 89-104.

Zhang et al., "Cleavage of tau by asparagine endopeptidase mediates the neurofibrillary pathology in Alzheimer's disease", Nature Medicine, Nov. 2014, vol. 20, No. 11, pp. 1254-1262.

Yuzwa et al., "Mapping O-GlcNAc modification sites on tau and generation of a site-specific O-GlcNAc tau antibody", Amino Acids, 2011, vol. 40, pp. 857-868.

Yoshida et al., "Sequential phosphorylation of tau protein by cAMP-dependent protein kinase and SAPK4/p38delta or JNK2 in the presence of heparin generates the AT100 epitope", Journal of Neurochemistry, vol. 99, 2006, pp. 154-164.

Yoshida et al., "Phosphorylation of microtubule-associated protein tau by AMPK-related kinases", Journal of Neurochemistry, vol. 120, 2012, pp. 165-176.

Yin et al., "Progressive Motor Deficit is Mediated by the Denervation of Neuromuscular Junctions and Axonal Degeneration in Transgenic Mice Expressing Mutant (P301S) Tau Protein", Journal of Alzheimer's Disease, vol. 60, 2017, pp. 1-17.

Yanamandra et al., "Anti-tau antibody reduces insoluble tau and decreases brain atrophy", vol. 2, No. 3, Mar. 2015 pp. 278-288.

Yanamandra et al., "Anti-tau antibody administration increases plasma tau in transgenic mice and patients with tauopathy", Science Translational Medicine, vol. 9, No. 386, Apr. 19, 2017, eaal2029.

Yanamandra et al., "Anti-Tau Antibodies that Block Tau Aggregate Seeding In Vitro Markedly Decrease Pathology and Improve Cognition In Vivo", Neuron. vol. 80, No. 2, Oct. 16, 2013, pp. 402-414.

Yamada et al., "In Vivo Microdialysis Reveals Age-Dependent Decrease of Brain Interstitial Fluid Tau Levels in P301S Human Tau Transgenic Mice", The Journal of Neuroscience, Sep. 14, 2011 vol. 31, No. 37, pp. 13110-13117.

Wu et al., "Small Misfolded Tau Species Are Internalized via Bulk Endocytosis and Anterogradely and Retrogradely Transported in Neurons", The Journal of Biological Chemistry, vol. 288, No. 3, Jan. 18, 2013, pp. 1856-1870.

Wu et al., "Neuronal activity enhances tau propagation and tau pathology in vivo", Nature Neuroscience, Aug. 2016, vol. 19, No. 8, pp. 1085-1092.

Woerman et al., "Tau prions from Alzheimer's disease and chronic traumatic encephalopathy patients propagate in cultured cells", Proceedings of the National Academy of Sciences, vol. 113, No. 50, Nov. 28, 2016, E8187-E8196.

Wischik et al., "Structural characterization of the core of the paired helical filament of Alzheimer disease", Proc. Natl. Acad. Sci. USA. vol. 85, Jul. 1988, pp. 4884-4888.

Wischik et al., "Isolation of a fragment of tau derived from the core of the paired helical filament of Alzheimer disease", Proc. Natl. Acad. Sci. USA, Jun. 1988, vol. 85, pp. 4506-4510.

West et al., "Preclinical and Clinical Development of ABBV-8E12, A Humanized Anti-Tau Antibody, for Treatment of Alzheimer's Disease and Other Tauopathies", The Journal of Prevention of Alzheimer's Disease, vol. 4, No. 4, 2017, pp. 236-241.

Wen Ko et al., "Assembly of filamentous tau aggregates in human neuronal cells", Journal of Alzheimer's Disease, vol. 6, No. 6, Dec. 2004, pp. 605-622.

Watanabe et al., "Deamidation and Isoaspartate Formation in Smeared Tau in Paired Helical Filaments: Unusual Properties of the Microtubule-Binding Domain of Tau", The Journal of Biological Chemistry, vol. 274, No. 11, Issue of Mar. 12, 1999, pp. 7368-7378.

Watanabe et al., "Biochemical classification of tauopathies by immunoblot, protein sequence and mass spectrometric analyses of sarkosyl-insoluble and trypsin-resistant tau", Acta Neuropathol, vol. 131, No. 2, pp. 267-280, 2016.

Ward et al., "TOC1: a valuable tool in assessing disease progression in the rTg4510 mouse model of tauopathy", Neurobiology of Disease, vol. 67, Jul. 2014, pp. 37-48.

Ward et al., "Tau oligomers and tau toxicity in neurodegenerative disease", Biochem. Soc. Trans., vol. 40, No. 4, Aug. 2012, pp. 667-671.

Wang et al., "The release and trans-synaptic transmission of Tau via exosomes", Molecular Neurodegeneration, vol. 12, No. 1, Jan. 13, 2017, pp. 1-25.

Wang et al., "Tau in physiology and pathology", Nature Reviews Neuroscience, vol. 17, No. 1, Jan. 2016, pp. 5-21.

Wang et al., "Stepwise proteolysis liberates tau fragments that nucleate the Alzheimer-like aggregation of full-length tau in a neuronal cell model", Proceedings of the National Academy of Sciences, vol. 104, No. 24, Jun. 12, 2007, pp. 10252-10257.

Wang et al., "Proteolytic processing of tau", Biochemical Society Transactions, vol. 38, part 4, 2010, pp. 955-961.

Wang et al., "Neonatal Fc receptor (FcRn): a novel target for therapeutic antibodies and antibody engineering", Journal of Drug Targeting, 2014, vol. 22, No. 4, pp. 269-278.

Wang et al., "Monoclonal Antibody Pharmacokinetics and Pharmacodynamics", Clinical Pharmacology Therapeutics,Nov. 2008, vol. 84, No. 5, pp. 548-558.

Wang et al., "Degradation of tau protein by autophagy and proteasomal pathways", Biochemical Society Transactions, 2012, vol. 40, pp. 644-652.

Walsh et al., "A critical appraisal of the pathogenic protein spread hypothesis of neurodegeneration", Nat Rev Neurosci. vol. 17, No. 4, Apr. 2016, pp. 251-260.

Walls et al., "p-Tau immunotherapy reduces soluble and insoluble tau in aged 3xTg-AD mice", Neuroscience Letters, 2014, vol. 575, pp. 96-100.

Vulliet et al., "Proline-directed Phosphorylation of Human Tau Protein", The Journal of Biological Clhemistry, vol. 267, No. 31, Issue of Nov. 5, 1992, pp. 22570-22574.

Von Bergen, M., Friedhoff, P., Biernat, J., Heberle, J., Mandelkow, E.M. and Mandelkow, E. (2000) Assembly of tau protein into Alzheimer paired helical filaments depends on a local sequence motif ((306)VQIVYK(311)) forming beta structure. Proc Natl Acad Sci U S A, 97, 5129-5134.

Von Bergen, M., Barghorn, S., Li, L., Marx, A., Biernat, J., Mandelkow, E.M. and Mandelkow, E. (2001) Mutations of tau protein in frontotemporal dementia promote aggregation of paired helical filaments by enhancing local beta-structure. J Biol Chem, 276, 48165-48174.

Vingtdeux et al., "Potential contribution of exosomes to the prion-like propagation of lesions in Alzheimer's disease", Frontiers in Physiology, vol. 3, Article 229, 2012, 16 pages.

Victoria et al., "The spread of prion-like proteins by lysosomes and tunneling nanotubes: Implications for neurodegenerative diseases", The Journal of Cell Biology, vol. 216, No. 9, Jan. 2017, 12 pages.

(56) References Cited

OTHER PUBLICATIONS

Vechterova et al., "DC11: a novel monoclonal antibody revealing Alzheimer's disease-specific tau epitope", Neuroreport, Jan. 2003, vol. 14, No. 1, pp. 87-91.

Vandebroek et al., "Identification and Isolation of a Hyperphosphorylated, Conformationally Changed Intermediate of Human Protein Tau Expressed in Yeast", Biochemistry, 2005, vol. 44, pp. 11466-11475.

Van Bebber, F., et al., Methylene blue fails to inhibit Tau and polyglutamine protein-dependent toxicity in zebrafish, Neurobiol. Dis. (2010), doi:10.1016/j.nbd.2010.03.023.

Utreras et al., "Cyclin-Dependent Kinase 5 Activator p35 Over-Expression and Amyloid Beta Synergism Increase Apoptosis in Cultured Neuronal Cells", Neuroscience, vol. 161, 2009, pp. 978-987.

Umeda et al., "Passive immunotherapy of tauopathy targeting pSer413-tau: a pilot study in mice", Annals of Clinical and Translational Neurology, vol. 2, No. 3, Mar. 2015, pp. 241-255.

Umeda et al., "Neurofibrillary tangle formation by introducing wild-type human tau into APP transgenic mice", Acta Neuropathol, 2014, vol. 127, pp. 685-698.

\* cited by examiner

Figure 11

```
IMGT        <-------FR1-IMGT-------><CDR1-I><----FR2-IMGT----><CDR2-I><-------------------FR3-IMGT-------------------><--CDR3--><----FR4---->
Kabat       <--------FR1-------><--CDR--><-----FR2------><---CDR2---><------------------FR3------------------><---CDR3---><----FR4---->
mouse 7G6   QVQLLQPGAELVKPGASVKMSCKASGYTFTTYWITWVKQRPGQGLEWIGDIYPGSSICNYNEKFKSKATLTVDTSSSTAYMQLNSLTSEDSAVYYCAREDGYDAWFAYWGQGTLVTVSA
IGHV1-46*03 ....V.S...VK........S.YMH..R.A.........M.I.N.SGGSTS.AQ..QGRV.M.R...T.V..E.S..R...T........                       .S
IGHV1-46*01 ....V.S...VK........S.YMH..R.A.........M.I.N.SGGSTS.AQ..QGRV.M.R...T.V..E.S..R...T........                       .S
IGHV1-2*02  ....V.S...VK........G.YMH..R.A.........M.W.N.N.GGT.AQ..QGRV.M.R...I....E.SR.R.D.T......                         .S IMGT        <-------FR1-IMGT--------><CDR1-IMGT><----FR2-IMGT----><CDR2-IMGT><--C--><----FR3-IMGT---><--CDR3--><----FR4---->
Kabat       <--------FR1---------><----CDR----><-----FR2------><---CDR2---><------------------FR3------------------><---CDR3---><----FR4---->
mouse 7G6   DVLMTQTPLSLPVSLGDQASISCRSSQSILHSNGNTYLEWYLQKPGQSPKLLICKVSNRFSGVPDRFSGSGSGTDFTLKISRVEAEDLGVYYCFQGSHVPPTFGSGTKLEIK
IGKV2-30*02 .V...S.....T..QP........LV..D......N.FQ.R.....RR..Y....D..........                M.T.W. ..Q.....
IGKV2-29*02 .IV........S.TF.QP..K....L...D.K...Y........Q...YE..S...........                  M..I.L. ..Q.....
IGKV2-29*03 .IV........S.TP.QP..K....L...D.K...Y........Q...YE..S...........                  M..I.L. ..Q.....
```

Figure 12 – Humanized 7G6Vh1/Vk2 variants

```
IMGT    <------FR1-IMGT------><-CDR1-I-><----FR2-IMGT---><-CDR2-I-><-----------------------FR3-IMGT------------------------><---CDR3---><----FR4---->
Kabat   <-----------FR1---------><--CDR1--><----FR2-----><----CDR2----><----------------------FR3-----------------------><---CDR3---><----FR4---->
mouse   QVQLLQPGAELVKPGASVIMSCKASGYTFTTYWITWVKQRPGQGLEWMGDIYPGSSICNYNEKFKSKATLTVDTSSSTAYMQLNSLTSEDSAVYYCAREDGYDAWFAYWGQGTLVTVSA
HCzu1   QVQLVQSGAEVKKPGASVKVSCKASGYTFTTYWITWVRQAPGQGLEWMGDIYPGSSICNYNEKFKSRVTMTRDTSTSTVYMELSSLRSEDTAVYYCAREDGYDAWFAYWGQGTLVTVSS
HCzu2   QVQLVQSGAEVKKPGASVKVSCKASGYTFTTYWITWVRQAPGQGLEWMGDIYPGSSICNYNEKFKSRVTMTVDTSTSTVYMELSSLRSEDTAVYYCAREDGYDAWFAYWGQGTLVTVSS
HCzu3   QVQLVQSGAEVKKPGASVKVSCKASGYTFTTYWITWVRQAPGQGLEWMGDIYPGSSICNYNEKFKSRVTMFVDTSTSTAYMELSSLRSEDTAVYYCAREDGYDAWFAYWGQGTLVTVSS
HCzu4   QVQLVQSGAEVKKPGASVKVSCKASGYTFTTYWITWVRQAPGQGLEWMGDIYPGSSICNYAQKFQGRVTMTVDTSTSTAYMELSSLRSEDTAVYYCAREDGYDAWFAYWGQGTLVTVSS
HCzu5   QVQLVQSGAEVKKPGASVKVSCKASGYTFTTYWITWVRQAPGQGLEWMGDIYPGSSISNYNEKFKSRVTMTVDTSTSTAYMELSSLRSEDTAVYYCAREDGYDAWFAYWGQGTLVTVSS
HCzu6   QVQLVQSGAEVKKPGASVKVSCKASGYTFTTYWITWVRQAPGQGLEWMGDIYPGSSISNYNEKFKSRVTMTVDTSTSTVYMELSSLRSEDTAVYYCAREDGYDAWFAYWGQGTLVTVSS
HCzu7   QVQLVQSGAEVKKPGASVKVSCKASGYTFTTYWITWVRQAPGQGLEWMGDIYPGSSISNYAQKFQGRVTMTRDTSTSTVYMELSSLRSEDTAVYYCAREDGYDAWFAYWGQGTLVTVSS
HCzu8   QVQLVQSGAEVKKPGASVKVSCKASGYTFTTYWITWVRQAPGQGLEWMGDIYPGSSISNYAQKFQGRVTMTVDTSTSTVYMELSSLRSEDTAVYYCAREDGYDAWFAYWGQGTLVTVSS
HCzu9   QVQLVQSGAEVKKPGASVKVSCKASGYTFTTYWITWVRQAPGQGLEWMGDIYPGSSICNYAQKFQGRVTMTVDTSTSTVYMELSSLRSEDTAVYYCAREDGYDAWFAYWGQGTLVTVSS
HCzu10  QVQLVQSGAEVKKPGASVKVSCKASGYTFTTYWITWVRQAPGQGLEWMGDIYPGSSICNYAQKFQGRVTMTRDTSTSTVYMELSSLRSEDTAVYYCAREDGYDAWFAYWGQGTLVTVSS IMGT    <------FR1-IMGT------><-CDR1-IMGT-><----FR2-IMGT----><--CDR2--><--------FR3-IMGT---------><-CDR3-><----FR4---->
Kabat   <-----------FR1---------><--CDR1--><----FR2----><---CDR2---><-----------FR3----------><-CDR3-><----FR4---->
mouse   DVLMTQTPLSLPVSLGDQASISCRSSQSILHSNGNTYLEWYLQKPGQSPKLLICKVSNRFSGVPDRFSGSGSGTDFTLKISRVEAEDLGVYYCFQGSHVPFTFGSGTKLEIK
LCzu1   DVVMTQSPLSLPVTLGQPASISCRSSQSILHSNGNTYLEWYQQRPGQSPRLLIYKVSNRFSGVPDRFSGSGSGTDFTLKISRVEAEDVGVYYCFQGSHVPFTFGQGTKLEIK
LCzu2   DVVMTQSPLSLPVTLGQPASISCRSSQSILHSNGNTYLEWYQQRPGQSPRLLIYKVSNRFSGVPDRFSGSGSGTDFTLKISRVEAEDVGVYYCFQGSHVPFTFGQGTKLEIK
LCzu3   DVVMTQSPLSLPVTLGQPASISCRSSQSILHSNGNTYLEWYQQRPGQSPRLLICKVSNRFSGVPDRFSGSGSGTDFTLKISRVEAEDVGVYYCFQGSHVPFTFGQGTKLEIK
LCzu4   DVVMTQSPLSLPVTLGQPASISCRSSQSILHSNGNTYLEWYQQRPGQSPRLLICKVSNRFSGVPDRFSGSGSGTDFTLKISRVEAEDVGVYYCFQGSHVPFTFGQGTKLEIK
LCzu5   DVVMTQSPLSLPVTLGQPASISCRSSQSILHSNGNTYLEWYQQRPGQSPRRLISKVSNRFSGVPDRFSGSGSGTDFTLKISRVEAEDVGVYYCFQGSHVPFTFGQGTKLEIK
LCzu6   DVVMTQSPLSLPVTLGQPASISCRSSQSILHSNGNTYLEWYQQRPGQSPRRLISKVSNRFSGVPDRFSGSGSGTDFTLKISRVEAEDVGVYYCFQGSHVPFTFGQGTKLEIK
LCzu7   DVVMTQSPLSLPVTLGQPASISCRSSQSILHSNGNTYLEWYQQRPGQSPRRLISKVSNRFSGVPDRFSGGGSGTDFTLKISRVEAEDVGVYYCFQGSHVPFTFGQGTKLEIK
LCzu8   DVVMTQSPLSLPVTLGQPASISCRSSQSIVHSNGNTYLEWYQQRPGQSPRRLISKVSNRFSGVPDRFSGSGSGTDFTLKISRVEAEDVGVYYCFQGSHVPFTFGQGTKLEIK
LCzu9   DVVMTQSPLSLPVTLGQPASISCRSSQSIVHSNGNTYLNWYQQRPGQSPRRLISKVSNRFSGVPDRFSGSGSGTDFTLKISRVEAEDVGVYYCFQGSHVPFTFGQGTKLEIK
LCzu10  DVVMTQSPLSLPVTLGQPASISCRSSQSIVHSNGNTYLEWYQQRPGQSPRRLISKVSNRFSGVPDRFSGSGSGTDFTLKISRVEAEDVGVYYCFQGSHVPFTFGQGTKLEIK
LCzu21  DVVMTQSPLSLPVTLGQPASISCRSSQSILHSNGNTYLEWYQQRPGQSPRRLISKVSNRFSGVPDRFSGSGSGTDFTLKISRVEAEDVGVYYCFQGSHVPFTFGQGTKLEIK
LCzu22  DVVMTQSPLSLPVTLGQPASISCRSSQSILHSNGNTYLEWYQQRPGQSPRRLISKVSNRFSGVPDRFSGSGSGTDFTLKISRVEAEDVGVYYCFQGSHVPFTFGQGTKLEIK
```

Figure 16

```
IMGT numbering  <-------FR1-IMGT-------><CDR1-I><---FR2-IMGT----><CDR2-I><-------FR3-IMGT--------><---CDR3---><---FR4--->
Kabat numbering <--------FR1-----------><--CDR-><-----FR2-------><----CDR2----><------FR3--------------><---CDR3---><---FR4--->
7G6-VH          QVQLLQPGAELVKPGASVIMSCKASGYTFTYWITWVKQRPGQGLEWIGDIVPGSSICNYNEKFKSKATLTVDSSSTAYMQLNSLTSEDSAVYYCAREDGYDAWFAYWGQGTLVTVSA
IGHV3-23*03     E...ES.GG..Q..G.LRL.A...F..SS.AMS..R.A..K...VSV..S..G.STY.ADSV.GRF.ISR.N.KN.L.L.M...RA..T.......K      .........S
IGHV3-30*02     ....VES.GGV.Q..G.LRL.A...F..SS.GMH..R.A..K...VAF.RVDG.NKV.ADSV.GRF.ISR.N.KN.L.L.M...RA..T.......K      .........S
HCzu11          EVQLLESGGGLVQPGGSLRLSCAASGYTFTYWITWVRQAPGKGLEWVSDIVPGSSICNYNEKFKSRFTISRDNSKNTLYLQMNSLRAEDTAVYYCAREDGYDAWFAYWGQGTLVTVSS IMGT numbering  <-------FR1-IMGT-------><CDR1-IMGT><---FR2-IMGT----><-CDR2-IMGT-><-------FR3-IMGT--------><-CDR3--><--FR4--->
Kabat numbering <--------FR1-----------><----CDR1-----><-----FR2-------><-CDR2-><------FR3-----------------><-CDR3--><--FR4--->
7G6-VL          DVLMTQTPLSLPVSLGDQASISCRSSQSILHSNGNTYLEWYLQKPGQSPKLLICKVSNRFSGVPDRFSGSGSGTDFTLKISRVEARDLGVYYCFQGSHVPFTFGSGTKLEIK
IGKV1-39*01     .IQ....S.S..SA.V..RVT.T..A..... ~~~~~SS..N..Q......KA.....YAA.SLQ.....S..........T..SLQP..FAT...Q.SYST.   ..Q........
IGKV1-17*01     .IQ....S.S..SA.V..RVT.T..A..G..------RND.G..Q....KA..R..YAA.SLQ.....S..........E..T..SLQP..FAT...L.HNSY.   ..Q........

LCzu11          DIQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIK
```

Figure 17

```
IMGT    <-------FR1-IMGT-------><CDR1-I><----FR2-IMGT----><CDR2-I><------------FR3-IMGT------------><---CDR.3---><----FR4--->
Kabat   <--------FR1--------><---CDR---><----FR2-----><----CDR2---><-------------FR3-------------><---CDR3---><----FR4--->
mouse   QVQLLQPGAELVKPGASVIMSCKASGYTFTTYWITWVKQRPGQLERIGDIYPGSSICNYNEKFKSKATLTVDTSSSTAYMQLNSLTSEDSAVYYCAREDGYDAWFAYWGQGTLVTVSA
HCzu11  EVQLLESGGGLVQPGGSLRLSCAASGYTFTTYWITWVRQAPGKGLEWVSDIYPGSSICNYNEKFKSRFTISRDNSKNTLYLQMNSLRAEDTAVYYCAKEDGYDAWFAYWGQGTLVTVSS
HCzu12  EVQLLESGGGLVQPGGSLRLSCAASGYTFTTYWITWVRQAPGKGLEWVGDIYPGSSICNYNEKFKSRFTISVDNSKSTAYLQMNSLRAEDTAVYYCAREDGYDAWFAYWGQGTLVTVSS
HCzu13  EVQLLESGGGLVQPGGSLRLSCAASGYTFTTYWITWVRQAPGKGLEWVGDIYPGSSICNYADSVKGRFTISVNSKSTAYLQMNSLRAEDTAVYYCAREDGYDAWFAYWGQGTLVTVSS
HCzu14  EVQLLESGGGLVQPGGSLRLSCAASGYTFTTYWITWVRQAPGKGLEWVGDIYPGSSICNYADKFKGRFTISVDNSKSTAYLQMNSLRAEDTAVYYCAREDGYDAWFAYWGQGTLVTVSS
HCzu15  EVQLLESGGGLVQPGGSLRLSCAASGYTFTTYWITWVRQAPGKGLEWVGDIYPGSSICNYNEKFKSRFTISVDNSKNTAYLQMNSLRAEDTAVYYCAREDGYDAWFAYWGQGTLVTVSS
HCzu16  EVQLLESGGGLVQPGGSLRLSCAASGYTFTTYWITWVRQAPGKGLEWVSDIYPGSSICNYNEKFKSRFTISVDNSKNTLYLQMNSLRAEDTAVYYCAREDGYDAWFAYWGQGTLVTVSS
HCzu17  EVQLLESGGGLVQPGGSLRLSCAASGYTFTTYWITWVRQAPGKGLEWVSDIYPGSSICNYNEKFKSRFTISVDNSKNTLYLQMNSLRAEDTAVYYCAREDGYDAWFAYWGQGTLVTVSS
HCzu18  EVQLLESGGGLVQPGGSLRLSCAASGYTFTTYWITWVRQAPGKGLEWVSDIYPGSSICNYNEKFKSRFTISRDNSKNTLYLQMNSLRAEDTAVYYCAREDGYDAWFAYWGQGTLVTVSS
HCzu19  EVQLLESGGGLVQPGGSLRLSCAASGYTFTTYWITWVRQAPGKGLEWVSDIYPGSSICMYADSVKGRFTISRDNSKNTLYLQMNSLRAEDTAVYYCAREDGYDAWFAYWGQGTLVTVSS
HCzu20  EVQLLESGGGLVQPGGSLRLSCAASGYTFTTYWITWVRQAPGKGLEWVSDIYPGSSICNYADSVKGRFTISRDNSKNTLYLQMNSLRAEDTAVYYCAREDGYDAWFAYWGQGTLVTVSS
HCzu21  EVQLLESGGGLVQPGGSLRLSCAASGYTFTTYWITWVRQAPGKGLEWVSDIYPGSSICNYADSVKGRFTISRDNSKNTLYLQMNSLRAEDTAVYYCAREDGYDAWFAYWGQGTLVTVSS
HCzu23  EVQLLESGGGLVQPGGSLRLSCAASGYTFTTYWITWVRQAPGKGLEWVSDIYPGSSISNYADSVKGRFTISRDNSKNTLYLQMNSLRAEDTAVYYCAREDGYDAWFAYWGQGTLVTVSS
HCzu24  EVQLLESGGGLVQPGGSLRLSCAASGYTFTTYWITWVRQAPGKGLEWVSDIYPGSSISNYNEKFKSRFTISRDNSKNTLYLQMNSLRAEDTAVYYCAREDGYDAWFAYWGQGTLVTVSS
HCzu25  EVQLLESGGGLVQPGGSLRLSCAASGYTFTTYWITWVRQAPGKGLEWVSDIYPGSSISNYNEKFKSRFTISVDNSKNTLYLQMNSLRAEDTAVYYCAREDGYDAWFAYWGQGTLVTVSS IMGT    <--------FR1-IMGT----------><CDR1-IMGT><----FR2-IMGT-----><-C-><----FR3-IMGT----><-CDR3--><----FR4---->
Kabat   <--------FR1--------><-----CDR1-----><----FR2-------><----CDR2---><--------FR3-------><---CDR3---><----FR4--->
mouse   DVLMTQTPLSLPVSLGDQASISCRSSQSILHSNGNTYLEWYLQKPGQSPKLLICKVSNRFSGVPDRFSGSGSGTDFTLKISRVEAEDLGVYYCFQGSHVPFTFGSGTKLEIK
LCzu11  DIQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIK
LCzu12  DVQMTQSPSSLSASVGDRVTITCRSSQSILHSNGNTYLEWYQQKPGKAPKLLICKVSNRFSGVPSRFSGSGSGTDFTLTISSLQPEDFATYYCFQGSHVPFTFGQGTKLEIK
LCzu13  DVQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIK
LCzu14  DIQMTQSPSSLSASVGDRVTITCRSSQSILHSNGNTYLEWYQQKPGKAPKLLICKVSNRFSGVPSRFSGSGSGTDFTLTISSLQPEDFATYYCFQGSHVPFTFGQGTKLEIK
LCzu15  DVQMTQSPSSLSASVGDRVTITCRSSQSIVHSNGNTYLEWYQQKPGKAPKLLISKVSNRFSGVPSRFSGSGSGTDFTLTISSLQPEDFATYYCFQGSHVPFTFGQGTKLEIK
LCzu16  DVQMTQSPSSLSASVGDRVTITCRSSQSIVHSNGNTYLNWYQQKPGKAPKLLISKVSNRFSGVPSRFSGSGSGTDFTLTISSLQPEDFATYYCFQGSHVPFTFGQGTKLEIK
LCzu17  DVQMTQSPSSLSASVGDRVTITCRSSQSIVHSNGNTYLNWYQQKPGKAPKLLISKVSNRFSGVPSRFSGSGSGTDFTLTISSLQPEDFATYYCFQGSHVPFTFGQGTKLEIK
```

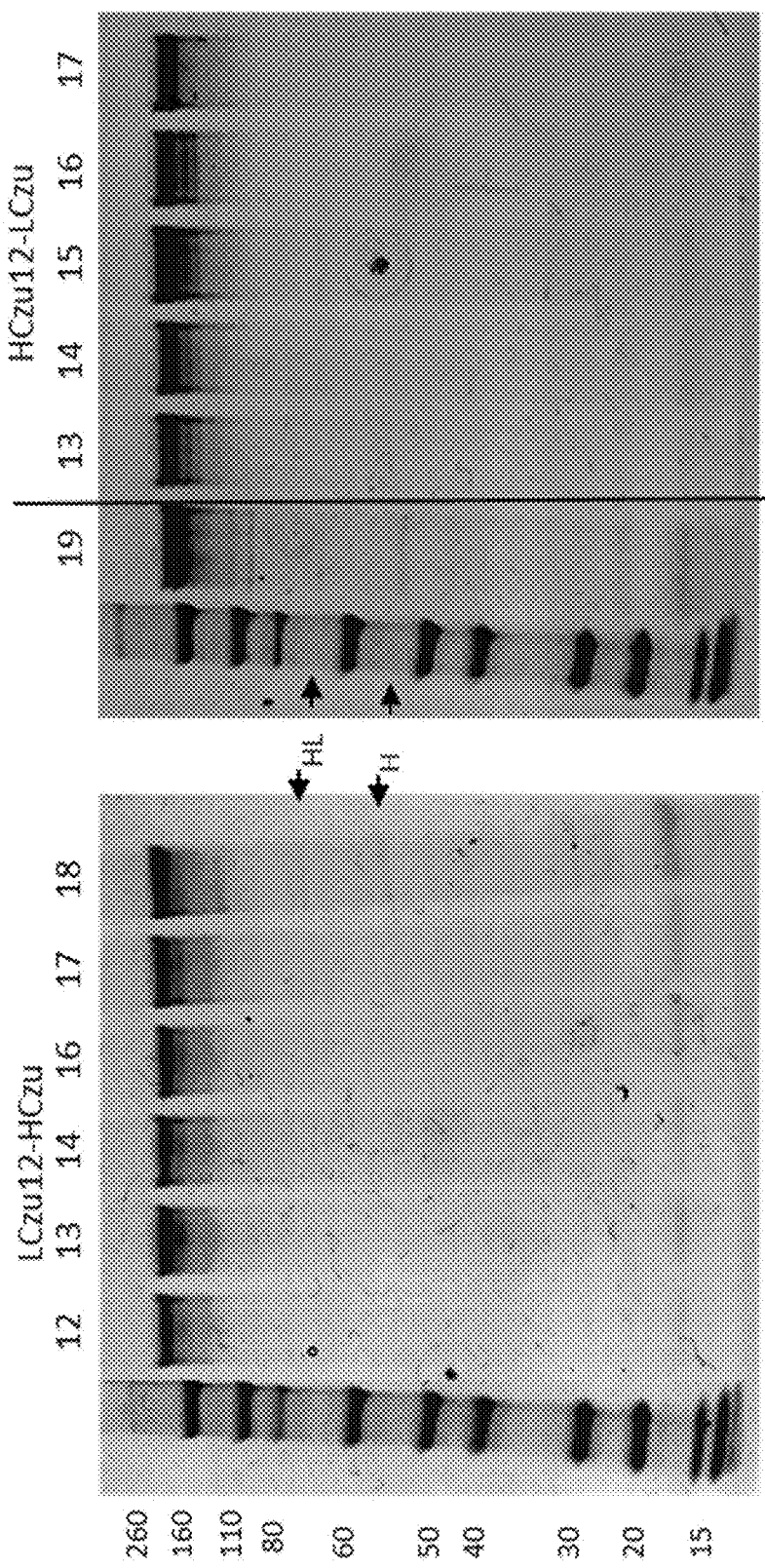
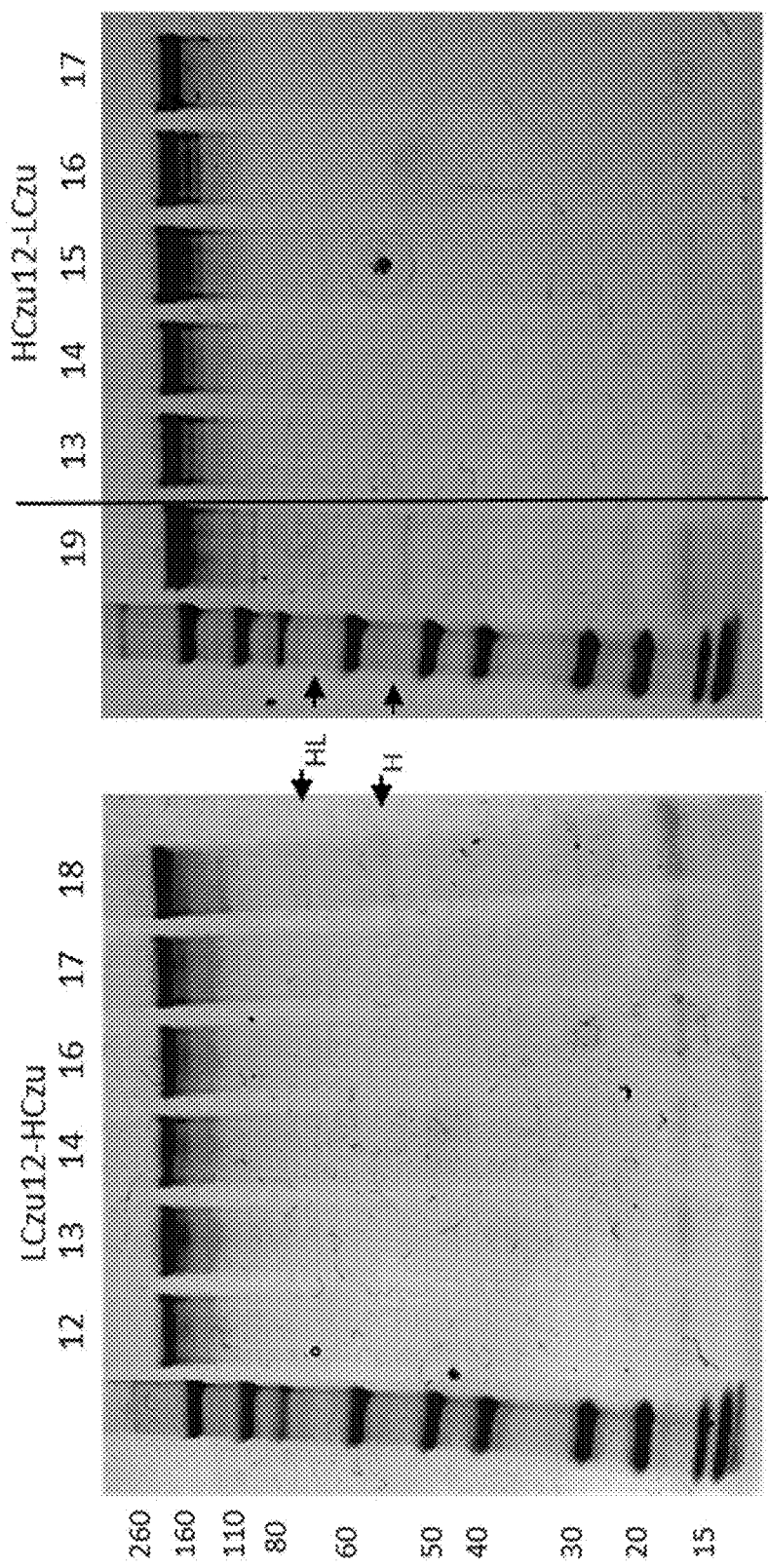
Figure 20B
Figure 20C

Figure 23A

HCzu8 Epitope Predictions

| Start | Peptide Sequence | #Binding Alleles | Max Residue Identity to Any Germline | % Germline 9/9 identity | % Germline 8/9 identity | DRB1* 0101 | DRB1* 0301 | DRB1* 0401 | DRB1* 0701 | DRB1* 0801 | DRB1* 1101 | DRB1* 1301 | DRB1* 1501 | |
|---|---|---|---|---|---|---|---|---|---|---|---|---|---|---|
| 2 | VQLVQSGAE | 1 | 9 | 14.37 | 18.48 | | | | | 3 | | | | |
| 4 | LVQSGAEVK | 1 | 9 | 15.25 | 17.89 | | | 3 | | | | | | |
| 18 | VKVSCKASG | 3 | 9 | 16.42 | 17.01 | | 2 | | | 5 | | 3 | | |
| 32 | YWITWVRQA | 3 | 7 | 0 | 0 | | | 3 | 5 | | 2 | | | 3-allele binder with no identity to representative germlines |
| 36 | WVRQAPGQG | 5 | 9 | 9.09 | 41.94 | 2 | 4 | 4 | | 3 | 3 | | | |
| 37 | VRQAPGQGL | 3 | 9 | 9.09 | 43.7 | 1 | | | 2 | | | | 4 | |
| 47 | WMGDIYPGS | 2 | 8 | 0 | 1.76 | | 3 | 4 | | | | | | |
| 57 | ISNYAQKFQ | 1 | 8 | 0 | 1.17 | | | | | 4 | | | | |
| 64 | EQGRVTMTR | 3 | 9 | 3.32 | 7.04 | | | 4 | | 1 | 2 | | | 3-allele binder with identity to ~3.5% of representative germlines (including the source for humanization), lower relative risk but worth noting |
| 70 | MTRDTSIST | 1 | 9 | 1.76 | 5.28 | | | 5 | | | | | | |
| 79 | VYMELSSLR | 1 | 9 | 0.88 | 10.85 | | | 2 | | | | | | |
| 80 | YMELSSLRS | 3 | 9 | 10.85 | 16.13 | 3 | | 1 | | | 1 | | | |
| 86 | LRSEDTAVY | 4 | 9 | 7.92 | 35.19 | | 5 | 1 | | 5 | | 4 | | |
| 93 | VYYCAREDG | 2 | 6 | 0 | 0 | | 4 | | | | | | 5 | |
| 108 | YWGQGTLVT | 2 | 0 | 0 | 0 | | | 2 | | | 4 | | | |

Figure 23B

HCzu25 Epitope Predictions

| Start | Peptide Sequence | #Binding Alleles | Max Residue Identity to Any Germline | % Germline 9/9 identity | % Germline 8/9 identity | DRB1*0101 | DRB1*0301 | DRB1*0401 | DRB1*0701 | DRB1*0801 | DRB1*1101 | DRB1*1301 | DRB1*1501 | |
|---|---|---|---|---|---|---|---|---|---|---|---|---|---|---|
| 2 | VQLLESGGG | 5 | 9 | 2.05 | 33.43 | 5 | 4 | 5 |  | 4 | 4 | 4 |  | 5-allele binder with identity to ~2% of representative germlines (including the source for humanization) – lower relative risk but worth noting |
| 12 | VQPGGSLRL | 3 | 9 | 18.48 | 38.71 | 4 |  |  | 1 |  |  |  |  | |
| 18 | LRLSCAASG | 6 | 9 | 32.26 | 40.47 | 2 | 1 | 2 |  | 4 | 5 | 2 |  | |
| 32 | YWITWVRQA | 3 | 7 | 0 | 0 |  |  | 3 | 5 |  | 2 | 2 |  | 3-allele binder with no identity to representative germlines |
| 36 | WVRQAPGKG | 5 | 9 | 28.74 | 54.55 | 2 | 4 | 4 |  | 3 | 3 | 3 |  | |
| 37 | VRQAPGKGL | 3 | 9 | 29.33 | 55.72 | 2 |  | 3 |  |  |  | 4 |  | |
| 47 | WVSDIYPGS | 2 | 7 | 0 | 0 |  | 2 | 2 |  |  |  |  |  | |
| 60 | YNEKFKSRF | 1 | 5 | 0 | 0 |  |  |  |  | 3 |  |  |  | |
| 64 | FKSRFTISV | 3 | 7 | 0 | 0 |  |  | 3 | 3 | 1 |  | 3 |  | 3-allele binder with identity to no representative germlines |
| 68 | FTISVDNSK | 1 | 8 | 0 | 15.84 |  |  | 3 |  |  |  |  |  | |
| 79 | LYLQMNSLR | 1 | 9 | 24.34 | 33.72 |  |  | 3 |  |  |  |  |  | |
| 80 | YLQMNSLRA | 6 | 9 | 24.63 | 31.67 | 1 |  | 1 | 5 | 3 | 1 |  | 3 | |
| 81 | LQMNSLRAE | 2 | 9 | 24.93 | 31.67 |  |  |  |  | 2 |  |  | 1 | |
| 83 | MNSLRAEDT | 1 | 9 | 21.41 | 29.03 | 4 |  |  |  |  |  |  |  | |
| 86 | LRAEDTAVY | 3 | 9 | 21.41 | 38.12 |  |  | 1 |  | 5 |  | 5 |  | |
| 93 | VYYCAREDG | 2 | 6 | 0 | 0 |  | 4 |  |  |  |  | 5 |  | |
| 108 | YWGQGTLVT | 2 | 0 | 0 | 0 |  |  | 2 |  |  | 4 |  |  | |

*Entries in HLA allele columns indicate % threshold at which binding was predicted for the given allele. Lower thresholds are more stringent.

Figure 24A

LCzu6 Epitope Predictions

| Start | Peptide Sequence | #Binding Alleles | Max Residue Identity to Any Germline | % Germline 9/9 Identity | % Germline 8/9 Identity | DRB1* 0101 | DRB1* 0301 | DRB1* 0401 | DRB1* 0701 | DRB1* 0801 | DRB1* 1101 | DRB1* 1301 | DRB1* 1501 | |
|---|---|---|---|---|---|---|---|---|---|---|---|---|---|---|
| 2 | WMTQSPLS | 7 | 9 | 2.97 | 4.95 | 2 | 1 | 1 | 4 | | 1 | 3 | 2 | overlapping 7-allele and 4-allele binders with identity to ~3% and ~5% of representative germlines |
| 3 | WMTQSPLSL | 4 | 9 | 4.95 | 15.84 | 2 | | | 4 | | 4 | 4 | | (including the source for humanization), respectively – both lower relative risk but worth noting |
| 9 | LSLPVTLGQ | 2 | 9 | 2.97 | 4.95 | | | 4 | | | 4 | | | |
| 13 | VTLGQPASI | 2 | 9 | 4.95 | 9.9 | 4 | 4 | | 5 | | | | | |
| 29 | LHSNGMTY | 1 | 8 | 0 | 0.99 | | | | | | | | | |
| 30 | LHSNGNTYL | 2 | 9 | 0.99 | 3.96 | 5 | | 4 | | | | | | |
| 40 | WYQQRPGQS | 2 | 8 | 0 | 2.97 | | | 4 | | | | 3 | | more risky, relative to our database, than matched peptide in LCzu6 |
| 51 | LLISKVSNR | 3 | 8 | 0 | 8.99 | | 1 | 3 | | | | | 3 | overlapping 3 and 1-allele binders with identity to no representative germlines |
| 52 | LISKVSNRF | 1 | 8 | 0 | 1.98 | | | | | | | | 2 | |
| 76 | FTLKISRVE | 1 | 9 | 17.82 | 20.79 | | | | | 1 | | | | |
| 78 | LKISRVEAE | 3 | 9 | 16.83 | 19.8 | | 2 | 3 | 4 | | | | | |
| 80 | ISRVEAEDV | 1 | 9 | 14.85 | 19.8 | | | | 5 | | | | | |
| 88 | VGVYYCFQG | 3 | 8 | 0 | 4.95 | | | | | 4 | 4 | | 2 | five overlapping binders of 1-3 alleles each having no identity |
| 90 | VYYCFQGSH | 1 | 7 | 0 | 0 | | | | | 5 | | | | to representative germlines – note each nonamer peptide extends |
| 91 | YYCFQGSHV | 2 | 6 | 0 | 0 | 2 | | 4 | | | | 4 | | 3 into CDR3, for which there is only partial germline alignment |
| 93 | CFQGSHVP | 1 | 6 | 0 | 0 | | 5 | 4 | | | 5 | | | |
| 94 | FQGSHVPFT | 3 | 5 | 0 | 0 | 3 | | | 5 | | 5 | | | |
| 101 | FTFGQGTKL | 2 | 0 | 0 | 0 | | | | 4 | | 3 | | | |
| 103 | FGQGTKLEI | 2 | 0 | 0 | 0 | | | | | | | | | |

Figure 24B

LCzu21 Epitope Predictions

| Start | Peptide Sequence | #Binding Alleles | Max Residue Identity to Any Germline | % Germline 9/9 Identity | % Germline 8/9 Identity | DRB1* 0101 | DRB1* 0301 | DRB1* 0401 | DRB1* 0701 | DRB1* 0801 | DRB1* 1101 | DRB1* 1301 | DRB1* 1501 | Notes |
|---|---|---|---|---|---|---|---|---|---|---|---|---|---|---|
| 2 | VMTQSPLS | 7 | 9 | 2.97 | 4.95 | 2 | 1 | 4 | 4 | | | 1 | 3 | 2 overlapping 7-allele and 4-allele binders with identity to ~3% and ~5% of representative germlines (including the source for humanization), respectively – both lower relative risk but worth noting |
| 3 | VMTQSPLSL | 4 | 9 | 4.95 | 15.84 | 2 | | 4 | 4 | | | 4 | 4 | |
| 9 | LSLPVTLGQ | 2 | 9 | 2.97 | 4.95 | | 4 | 4 | | | | | | |
| 13 | VTLGQPASI | 2 | 9 | 4.95 | 9.9 | 4 | | | 5 | | | | | |
| 29 | ILHSNGNTY | 1 | 8 | 0 | 0.99 | 5 | | 4 | | | | | | |
| 30 | LHSNGNTYL | 2 | 9 | 0.99 | 3.96 | | | | | | | | 5 | Not present in LCzu6, but low risk epitope. |
| 38 | LEWFCQRPG | 1 | 8 | 0 | 2.97 | | 5 | 5 | | | | | | Less risky, relative to our database, than matched peptide in LCzu6. |
| 40 | WFQQRPGQS | 2 | 9 | 2.97 | 2.97 | | | | | | | 3 | 3 | overlapping 3 and 1-allele binders with identity to no representative germlines |
| 51 | LLISKVSNR | 3 | 8 | 0 | 0.99 | | 3 | 3 | | | | | | |
| 52 | LISKVSNRF | 1 | 8 | 0 | 1.98 | | | | | | | | 2 | |
| 76 | FTLKISRVE | 1 | 9 | 17.82 | 20.79 | | | | | 1 | | | | |
| 78 | LKISRVEAE | 3 | 9 | 16.83 | 19.8 | | 2 | 3 | 4 | | | | | |
| 80 | ISRVEAEDV | 1 | 9 | 14.85 | 19.8 | | | | 5 | | | | | |
| 88 | VGVYYCFQG | 3 | 8 | 0 | 4.95 | | | | | 4 | | | 4 | 2 five overlapping binders of 1-3 alleles each having no identity to representative germlines – note each nonamer peptide extends |
| 90 | VYYCFQGSH | 1 | 7 | 0 | 0 | | | | | 5 | | | | |
| 91 | YYCFQGSHV | 2 | 6 | 0 | 0 | 2 | | | | | | | | |
| 92 | YCFQGSHVP | 1 | 6 | 0 | 0 | | | 4 | | | | | | |
| 94 | FQGSHVPFT | 3 | 5 | 0 | 0 | | 5 | 4 | | | | 5 | | 3 into CDR3, for which there is only partial germline alignment |
| 101 | FTFGQGTKL | 2 | 0 | 0 | 0 | 3 | | | 5 | | | | | |
| 103 | FGQGTKLEI | 2 | 0 | 0 | 0 | | | | 4 | | 3 | | | |

Figure 24C

LCzu15 Epitope Predictions

| Start | Peptide Sequence | #Binding Alleles | Max Residue Identity to Any Germline | % Germline 9/9 Identity | % Germline 8/9 Identity | DRB1* 0101 | DRB1* 0301 | DRB1* 0401 | DRB1* 0701 | DRB1* 0801 | DRB1* 1101 | DRB1* 1301 | DRB1* 1501 | |
|---|---|---|---|---|---|---|---|---|---|---|---|---|---|---|
| 2 | VQMTQSPSS | 5 | 8 | 0 | 31.68 | 5 | 3 | 1 | | | | 3 | | 4,5-allele binder with no identity to representative germlines |
| 4 | MTQSPSSLS | 1 | 9 | 27.72 | 47.52 | | | 4 | | | | | | |
| 29 | ILHSNGNTY | 1 | 8 | 0 | 0.99 | | | | 5 | | | | | |
| 30 | LHSNGNTYL | 2 | 9 | 0.99 | 3.96 | 5 | | 4 | | | | | | |
| 40 | WYQQKPGKA | 2 | 9 | 23.76 | 64.36 | 5 | | | | | 5 | | | |
| 51 | LLSKVSNR | 3 | 8 | 0 | 0.99 | | 1 | 3 | | | | 3 | | overlapping 4 and 1-allele binders with identity to zero and ~1% |
| 52 | LSKVSNRF | 1 | 8 | 0 | 1.98 | | | | | | | | 2 | of representative germlines, respectively |
| 60 | FSGVPSRFS | 1 | 9 | 1.98 | 43.56 | | | | | | 5 | | | |
| 76 | FTLTISSLQ | 1 | 9 | 37.62 | 63.37 | | | 1 | | | | | | |
| 88 | FATYYCFQG | 1 | 7 | 0 | 0 | | | | | 4 | | | | four overlapping binders of 1-3 alleles each having no identity |
| 91 | YYCFQGSHV | 2 | 6 | 0 | 0 | 2 | | | | | | | | to representative germlines – note each nonamer peptide extends |
| 92 | YCFQGSHVP | 1 | 6 | 0 | 0 | | | 4 | | | | | 3 | into CDR3, for which there is only partial germline alignment |
| 94 | FQGSHVPFT | 3 | 5 | 0 | 0 | | 5 | 4 | 5 | | | 5 | | |
| 101 | FTFGQGTKL | 2 | 0 | 0 | 0 | 3 | | | 5 | | | | | |
| 103 | FGQGTKLEI | 2 | 0 | 0 | 0 | | | | 4 | | 3 | | | |

Figure 24D

LCzu18 Epitope Predictions

| Start | Peptide Sequence | #Binding Alleles | Max Residue Identity to Any Germline | % Germline 9/9 Identity | % Germline 8/9 Identity | DRB1* 0101 | DRB1* 0301 | DRB1* 0401 | DRB1* 0701 | DRB1* 0801 | DRB1* 1101 | DRB1* 1301 | DRB1* 1501 |
|---|---|---|---|---|---|---|---|---|---|---|---|---|---|
| 2 | IQMTQSPSS | 5 | 9 | 31.68 | 47.52 | 5 | 3 | 1 | | | 3 | | 4 |
| 4 | MTQSPSSLS | 1 | 9 | 27.72 | 47.52 | | | 4 | | | | | |
| 29 | ILHSNGNTY | 1 | 8 | 0 | 0.99 | | | | 5 | | | | |
| 30 | LHSNGNTYL | 2 | 9 | 0.99 | 3.96 | 5 | | 4 | | | | | |
| 40 | WYQQKPGKA | 2 | 9 | 23.76 | 64.36 | 5 | | | | | 5 | | |
| 51 | LLISKYSNR | 3 | 8 | 0 | 0.99 | | 1 | 3 | | | | 3 | |
| 52 | LISKYSNRF | 1 | 8 | 0 | 1.98 | | | | | | | 2 | |
| 60 | FSGVPSRFS | 1 | 9 | 1.98 | 43.56 | | 5 | | | | 5 | | |
| 76 | FTLTISSLQ | 1 | 9 | 37.62 | 63.37 | | | 1 | | | | | |
| 88 | FATYYCFQG | 3 | 7 | 0 | 0 | | | | | 4 | | | |
| 91 | YYCFQGSHV | 2 | 6 | 0 | 0 | 2 | | | | | | | 3 |
| 92 | YCFQGSHVP | 1 | 6 | 0 | 0 | | | 4 | | | | | |
| 94 | FQGSHVPFT | 3 | 5 | 0 | 0 | | 5 | 4 | 5 | | 5 | | |
| 101 | FTFGQGTKL | 2 | 0 | 0 | 0 | 3 | | | 5 | | | | |
| 103 | FGQGTKLEI | 2 | 0 | 0 | 0 | | | | 4 | | 3 | | |

*Entries in HLA allele columns indicate % threshold at which binding was predicted for the given allele. Lower thresholds are more stringent.

overlapping 4 and 1-allele binders with identity to zero and ~1% of representative germlines, respectively four overlapping binders of 1-3 alleles each having no identity to representative germlines – note each nonamer peptide extends into CDR3, for which there is only partial germline alignment Figure 26A
7G6-HCzu8-LCzu6
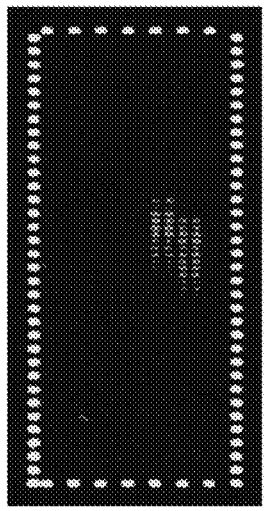
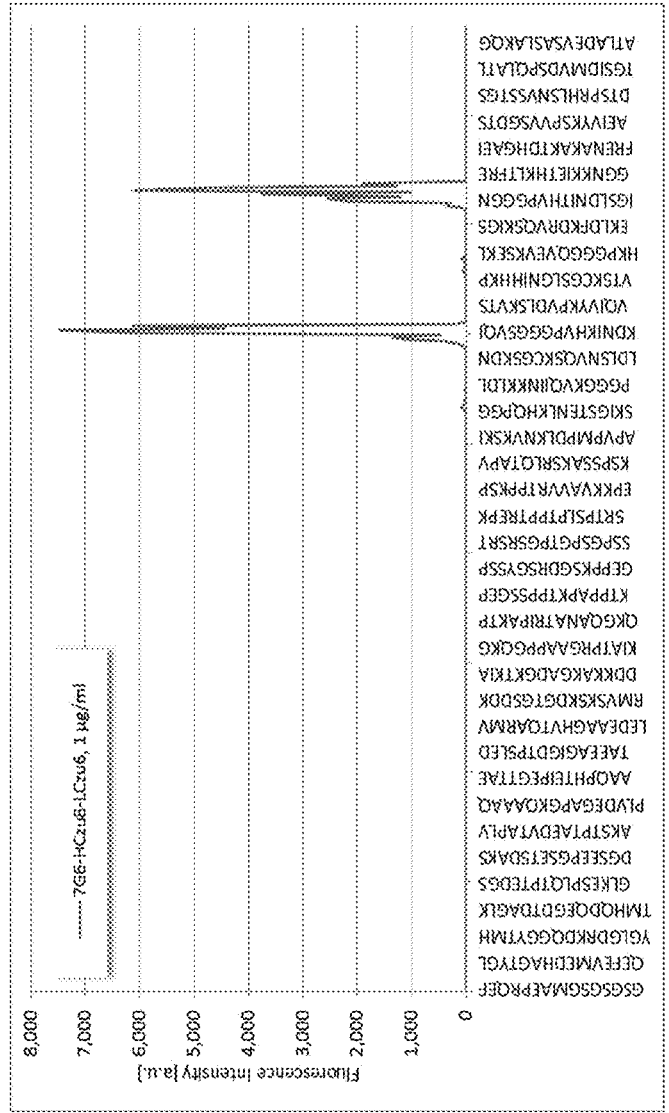

Figure 26B
7G6-HCzu25-LCzu18
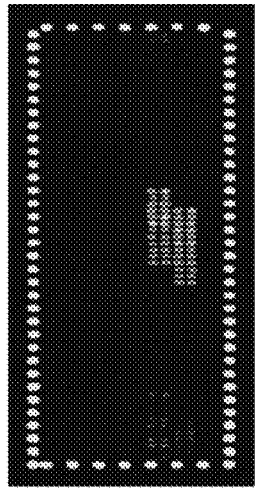
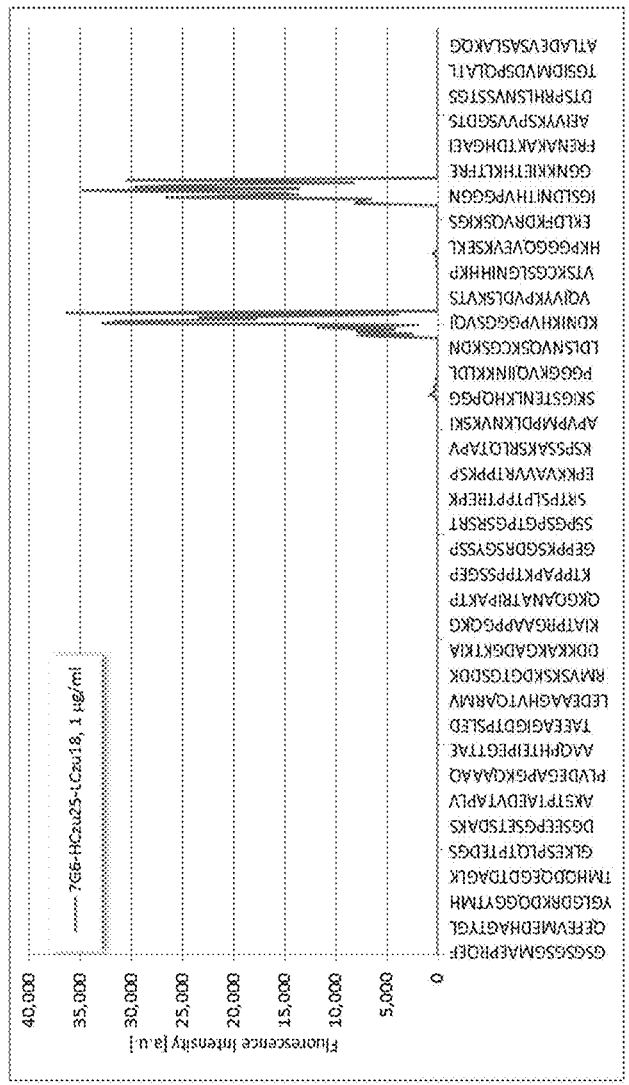

Cell based seeding effects of K18 fibril after immunodepletion with 7G6-HCzu25-LCzu18

ANTI-TAU ANTIBODIES AND USES THEREOF

CROSS-REFERENCE TO RELATED APPLICATIONS

This application is a continuation of U.S. application Ser. No. 16/161,586, filed Oct. 16, 2018, which claims the benefit of U.S. Application No. 62/572,910, filed Oct. 16, 2017; U.S. Application No. 62/577,011, filed Oct. 25, 2017; and U.S. Application No. 62/697,034, filed Jul. 12, 2018. Each of these applications is incorporated herein by reference in its entirety.

SEQUENCE LISTING

This application includes a Sequence Listing submitted electronically as a text file named "104018_001038_SL.txt", created on Dec. 11, 2018 with a size of 892,928 bytes. The Sequence Listing is incorporated by reference herein.

TECHNICAL FIELD

The present invention relates to antibodies that specifically bind Tau and methods of using the same.

BACKGROUND

Human Tau is encoded by the microtubule-associated protein Tau gene, MAPT, located on chromosome 17q21. The adult human brain contains six main Tau isoforms which are generated by alternative splicing of exon 2 (E2), E3, and E10. These isoforms differ depending on the number of 29-residue repeat regions near the N-terminus. Tau isoforms containing 0, 1, or 2 inserts are known as 0N, 1N, and 2N, respectively. Unprocessed Tau isoforms also contain either 3 ("3R") or 4 ("4R") microtubule-binding repeat domains. The second of these repeat domains is encoded by E10 and is not included in 3R Tau isoforms (FIG. 1).

Although Tau is usually highly soluble, under pathological conditions, it can aggregate into paired helical filaments, neurofibrillary tangles and other structures that define a large spectrum of neurodegenerative diseases termed Tauopathies. Tauopathy thus refers to a class of neurodegenerative diseases associated with aggregation of the microtubule-associated protein Tau, including Alzheimer's disease (AD), progressive supranuclear palsy (PSP), and frontotemporal dementia (FTD).

The underlying mechanism of Tau-mediated neurotoxicity is poorly understood and the trigger for Tau aggregation in neurons is yet to be elucidated. Thus, while therapeutic approaches targeting Tau are being explored, there remains a need for specific and effective therapeutic agents that target Tau.

SUMMARY

Provided herein are monoclonal antibodies, or antigen-binding fragments thereof, that specifically bind a human Tau isoform or fragment. In some aspects, the antibody is murine antibody, a chimeric antibody, or a humanized antibody. In some embodiments, the antibody isotype is IgG1. In some embodiments, the antibody comprises: a heavy chain complementarity determining region 1 (HCDR1), a heavy chain complementarity determining region 2 (HCDR2), and a heavy chain complementarity determining region 3 (HCDR3) as set forth in SEQ ID NO: 196 and a light chain complementarity determining region 1 (LCDR1), a light chain complementarity determining region 2 (LCDR2), and a light chain complementarity determining region 3 (LCDR3) as set forth in SEQ ID NO: 411; a HCDR1, a HCDR2, and a HCDR3 as set forth in SEQ ID NO: 268 and a LCDR1, a LCDR2, and a LCDR3 as set forth in SEQ ID NO: 465; or a HCDR1, a HCDR2, and a HCDR3 as set forth in SEQ ID NO: 402 and a LCDR1, a LCDR2, and a LCDR3 as set forth in SEQ ID NO: 572. In some embodiments, the monoclonal antibody or antigen-binding fragment thereof comprises a HCDR1 comprising SEQ ID NO: 594, a HCDR2 comprising SEQ ID NO: 596, a HCDR3 comprising SEQ ID NO: 598, a LCDR1 comprising SEQ ID NO: 738, a LCDR2 comprising SEQ ID NO: 740, and a LCDR3 comprising SEQ ID NO: 742 as defined according to the method of Kabat; a HCDR1 comprising SEQ ID NO: 864, a HCDR2 comprising SEQ ID NO: 866, a HCDR3 comprising SEQ ID NO: 868, a LCDR1 comprising SEQ ID NO: 1008, a LCDR2 comprising SEQ ID NO: 1010, and a LCDR3 comprising SEQ ID NO: 1012 as defined by IMGT; a HCDR1 comprising SEQ ID NO: 642, a HCDR2 comprising SEQ ID NO: 644, a HCDR3 comprising SEQ ID NO: 646, a LCDR1 comprising SEQ ID NO: 774, a LCDR2 comprising SEQ ID NO: 776, and a LCDR3 comprising SEQ ID NO: 778 as defined according to the method of Kabat; a HCDR1 comprising SEQ ID NO: 912, a HCDR2 comprising SEQ ID NO: 914, a HCDR3 comprising SEQ ID NO: 916, a LCDR1 comprising SEQ ID NO: 1044, a LCDR2 comprising SEQ ID NO: 1046, and a LCDR3 comprising SEQ ID NO: 1048 as defined by IMGT; a HCDR1 comprising SEQ ID NO: 732, a HCDR2 comprising SEQ ID NO: 734, a HCDR3 comprising SEQ ID NO: 736, a LCDR1 comprising SEQ ID NO: 846, a LCDR2 comprising SEQ ID NO: 848, and a LCDR3 comprising SEQ ID NO: 850 as defined according to the method of Kabat; or a HCDR1 comprising SEQ ID NO: 1002, a HCDR2 comprising SEQ ID NO: 1004, a HCDR3 comprising SEQ ID NO: 1006, a LCDR1 comprising SEQ ID NO: 1116, a LCDR2 comprising SEQ ID NO: 1118, and a LCDR3 comprising SEQ ID NO: 1120 as defined by IMGT.

According to some aspects, the aforementioned monoclonal antibodies or antigen-binding fragments thereof comprise sequence modifications. In some embodiments, modification(s) is position 49 of the light chain according to the method of Kabat is not cysteine, the residue at position 57 of the heavy chain according to the method of Kabat is not cysteine, the residue at position 34 of the light chain according to the method of Kabat is glutamate, the residue at position 36 of the light chain according to the method of Kabat is not phenylalanine, the residue at position 46 of the light chain according to the method of Kabat is not arginine, the residue at position 94 of the heavy chain according to the method of Kabat is not lysine, the residue at position 71 of the heavy chain according to the method of Kabat is not arginine, or any combination thereof. In some embodiments in which the residue at position 49 of the light chain according to the method of Kabat is not cysteine, the residue is serine. In some embodiments in which the residue at position 57 of the heavy chain according to the method of Kabat is not cysteine, the residue is serine. In some embodiments in which the residue at position 36 of the light chain according to the method of Kabat is not phenylalanine, the residue is tyrosine. In some embodiments in which the residue at position 46 of the light chain according to the method of Kabat is not arginine, the residue is leucine. In some embodiments in which the residue at position 71 of the heavy chain according to the method of Kabat is not arginine, the residue is valine.

In some embodiments of the monoclonal antibody or antigen-binding fragment that specifically binds human Tau, the antibody comprises: a heavy chain variable domain (HCVD) comprising SEQ ID NO: 268 and a light chain variable domain (LCVD) comprising SEQ ID NO: 465; a HCVD comprising SEQ ID NO: 268 and a LCVD comprising SEQ ID NO: 581; a HCVD comprising SEQ ID NO: 384 and a LCVD comprising SEQ ID NO: 545; a HCVD comprising SEQ ID NO: 393 and a LCVD comprising SEQ ID NO: 545; a HCVD comprising SEQ ID NO: 402 and a LCVD comprising SEQ ID NO: 545; a HCVD comprising SEQ ID NO: 384 and a LCVD comprising SEQ ID NO: 572; a HCVD comprising SEQ ID NO: 393 and a LCVD comprising SEQ ID NO: 572; or a HCVD comprising SEQ ID NO: 402 and a LCVD comprising SEQ ID NO: 572.

In some embodiments of the monoclonal antibody or antigen-binding fragment that specifically binds human Tau, the antibody is produced by the cell line having ATCC deposit number PTA-124523 or ATCC deposit number PTA-124524.

In some embodiments, the antibodies or antigen-binding fragments provided herein bind monomeric wild-type human 2N4R Tau with a $K_D$ of less than about 0.5 nM as measured by surface plasmon resonance. In some embodiments, the antibodies or antigen-binding fragments bind human Tau at an epitope comprising the amino acid sequence HVPG (SEQ ID NO: 1133). Also provided are biepitopic antibodies or antigen-binding fragments that bind human Tau at an epitope comprising the amino acid sequence HVPG (SEQ ID NO: 1133) within repeat region 2 or repeat region 4. In certain aspects, the antibodies or antigen-binding fragments bind human Tau at an epitope comprising the amino acid sequence HVPGG (SEQ ID NO: 79). Also provided are biepitopic antibodies or antigen-binding fragments that bind human Tau at an epitope comprising the amino acid sequence HVPGG (SEQ ID NO: 79) within repeat region 2 or repeat region 4. In some embodiments, the monoclonal antibody or antigen-binding fragment binds human Tau at the epitope comprising the amino acid sequence HVPGG (SEQ ID NO: 79) within repeat region 2 and/or repeat region 4 with a binding preference that is at least about 10-fold greater than binding at an epitope comprising the amino acid sequence HKPGG (SEQ ID NO: 182) within repeat region 3 or at an epitope comprising the amino acid sequence HQPGG (SEQ ID NO: 183) within repeat region 1, as determined by a peptide binding assay. In some aspects, the antibodies or antigen-binding fragments provided herein do not bind Tau at an epitope comprising the amino acid sequence HVSGG (SEQ ID NO: 184) within repeat region 2 or at an epitope comprising the amino acid sequence HVLGG (SEQ ID NO: 185) within repeat region 2.

In some embodiments, the monoclonal antibodies or antigen-binding fragments as provided herein are labeled.

Further provided are nucleic acid molecules encoding any of the described monoclonal antibodies or antigen-binding fragments, vectors comprising the nucleic acid molecules, cells that express the nucleic acid molecules, and methods of producing the anti-Tau antibodies or antigen-binding fragments by culturing such cells under conditions suitable for production thereof. The methods of producing may further involve recovery of the antibody or antigen-binding fragment.

Also provided herein are pharmaceutical compositions of any of the described monoclonal antibodies, or antigen-binding fragments thereof, that specifically bind a human Tau and a pharmaceutically acceptable carrier.

Methods of use of the described monoclonal antibodies, or antigen-binding fragments thereof, that specifically bind a human Tau also are provided herein. In some embodiments, the antibodies or antigen-binding fragments that specifically bind a human Tau are for use as a medicament. In some aspects, the antibodies or antigen-binding fragments that specifically bind a human Tau are for use in the treatment of a Tauopathy or in the preparation of a medicament for the treatment of a Tauopathy. Methods of treating a Tauopathy in a subject also are provided. In some embodiments, the methods of treating a Tauopathy involve administering to the subject any of the described monoclonal antibodies, or antigen-binding fragments thereof, that specifically bind a human Tau under conditions effective to treat the Tauopathy in the subject. In some aspects, the Tauopathy is Alzheimer's disease, frontotemporal dementia, or progressive supranuclear palsy. The frontotemporal dementia may be Pick's Disease, for example.

Further provided are methods for decreasing sarkosyl-insoluble Tau levels in a subject by administering to the subject any of the described monoclonal antibodies, or antigen-binding fragments thereof, that specifically bind a human Tau. Also provided are methods for inhibiting Tau aggregation in a subject by administering to the subject any of the described monoclonal antibodies, or antigen-binding fragments thereof, that specifically bind a human Tau. The methods may be performed in vitro or in vivo.

BRIEF DESCRIPTION OF THE DRAWINGS

FIG. 2 discloses SEQ ID NOS. 1137, 1138 and 1138, respectively, in order of appearance.

FIG. 3B shows spot intensity as a result of antibody binding to the peptide chip, quantified by the LI-COR Odyssey™ and Pepslide™ Analyser software packages. Fluorescence intensity was then plotted against peptide sequence to generate the epitope mapping data. FIG. 3B discloses SEQ ID NOS 1139-1140 and 1-37, respectively, in order of appearance.

FIG. 4 illustrates the results for select peptides (SEQ ID NOs 38-78, respectively). While ms7G6 antibody binding allows some variation in the second position (valine) of SEQ ID NO: 79, antibody binding is completely dependent on the proline residue of SEQ ID NO: 79. No binding of antibody 7G6 to KDNIKHVSGGGSVQI (SEQ ID NO: 59) was observed. The latter is the sequence present in Tau P301S mutant protein.

FIG. 11 illustrates the closest homologous human germline sequences to murine anti-Tau antibody ms7G6. ms7G6 and homologous human germline sequences were aligned. The Vh and VK domains are annotated by the IMGT and Kabat numbering systems. Identical residues are represented as a "." in the human germline sequences. FIG. 11 discloses SEQ ID NOS 1141-1144, 1143, 1145, 1143, 1146-1149, 1148, 1150 and 1148, respectively, in order of appearance.

FIG. 12 compares the sequences of ms7G6 antibody heavy and light chain to humanized 7G6 Vh1 and Vk2 variants. The murine 7G6 and humanized 7G6 variants were aligned. The Vh and Vk domains are annotated by the IMGT and Kabat numbering systems. Mutations are underlined. FIG. 12 discloses SEQ ID NOS 1151-1174, respectively, in order of appearance.

FIG. 16 illustrates the BLAST alignment of antibody ms7G6 ("7G6") to the human germline database at www_ncbi_nlm_nih_gov/igblast. The Vh and Vk domains are annotated by the IMGT and Kabat numbering systems. FIG. 16 discloses SEQ ID NOS 1175-1178, 1177, 1179, 1180-1183, 1182 and 1184, respectively, in order of appearance.

FIG. 17 illustrates an alignment of ms7G6 and humanized 7G6 Vh3/Vk1 variants. The Vh and VK domains are annotated by the IMGT and Kabat numbering systems. Mouse and humanized 7G6 variants were aligned. The Vh and VK domains are annotated by the IMGT and Kabat numbering systems. Mutations are underlined. FIG. 17 discloses SEQ ID NOS 1185-1207, respectively, in order of appearance.

FIG. 19A demonstrates direct binding of Tau by ms7G6, non-Tau binding IgG1 control Ab mAb2, and humanized 7G6 Vh3/Vκ1 variants 7G6-HCzu12-LCzu12 ("HCzu12-LCzu12"), 7G6-HCzu13-LCzu12 ("HCzu13-LCzu12"), 7G6-HCzu14-LCzu12 ("HCzu14-LCzu12"), 7G6-HCzu15-LCzu12 ("HCzu15-LCzu12"), 7G6-HCzu16-LCzu12 ("HCzu16-LCzu12"), 7G6-HCzu17-LCzu12 ("HCzu17-LCzu12"), 7G6-HCzu18-LCzu12 ("HCzu18-LCzu12"), 7G6-HCzu19-LCzu12 ("HCzu19-LCzu12"), and 7G6-HCzu20-LCzu12 ("HCzu20-LCzu12"). FIG. 19B demonstrates direct binding of Tau by ms7G6, non-Tau binding IgG1 control Ab mAb2, and humanized 7G6 Vh3/Vκ1 variants 7G6-HCzu12-LCzu12 ("HCzu12-LCzu12"), 7G6-HCzu12-LCzu13 ("HCzu12-LCzu13"), 7G6-HCzu12-LCzu14 ("HCzu12-LCzu14"), 7G6-HCzu12-LCzu15 ("HCzu12-LCzu15"), 7G6-HCzu12-LCzu16 ("HCzu12-LCzu16"), and 7G6-HCzu12-LCzu17 ("HCzu12-LCzu17"). Samples were incubated for 1 hour at room temperature in 96-well plates coated with 2N4R wild-type recombinant Tau protein. After the plates were washed, HRP-conjugated anti-mouse or anti-human detection antibodies were added to the wells. The amount of HRP activity in each well was measured by QuantaBlu™ fluorescent substrate and the RFUs were detected by a SpectraMax M5 plate reader.

FIGS. 20A, 20B, and 20C illustrate the results of the non-reducing SDS-PAGE analysis of heavy chain/light chain stability for Vh3 and Vκ1 variants of antibody 7G6. FIG. 20A illustrates the results of the SDS-PAGE analysis of heavy chain/light chain stability for Vh3 and Vκ1 variants 7G6-HCzu11-LCzu11 ("HCzu11-LCzu11"), 7G6-HCzu11-LCzu12 ("HCzu11-LCzu12"), 7G6-HCzu12-LCzu11 ("HCzu12-LCzu11"), and 7G6-HCzu12-LCzu12 ("HCzu12-LCzu12"). FIG. 20B illustrates the results of the SDS-PAGE analysis of heavy chain/light chain stability for Vh3 and Vκ1 variants 7G6-HCzu12-LCzu12 ("HCzu12-LCzu12"), 7G6-HCzu13-LCzu12 ("HCzu13-LCzu12"), 7G6-HCzu14-LCzu12 ("HCzu14-LCzu12"), 7G6-HCzu16-LCzu12 ("HCzu16-LCzu12"), 7G6-HCzu17-LCzu12 ("HCzu17-LCzu12"), and 7G6-HCzu18-LCzu12 ("HCzu18-LCzu12"). FIG. 20C illustrates the results of the SDS-PAGE analysis of heavy chain/light chain stability for Vh3 and Vκ1 variants 7G6-HCzu12-LCzu19 ("HCzu12-LCzu19"), 7G6-HCzu12-LCzu13 ("HCzu12-LCzu13"), 7G6-HCzu12-LCzu14 ("HCzu12-LCzu14"), 7G6-HCzu12-LCzu15 ("HCzu12-LCzu15"), 7G6-HCzu12-LCzu16 ("HCzu12-LCzu16"), and 7G6-HCzu12-LCzu17 ("HCzu12-LCzu17"). Two micrograms of each mAb were mixed with 4× NuPAGE™ LDS Sample Buffer in the absence of reducing agent and loaded onto a 4-12% Bis-Tris SDS-PAGE gel in MOPS buffer. Gels were stained with InstantBlue™ and destained in water. HC-LC dimers (HL) and free HC are indicated by arrows. The molecular weight markers are indicated in kDa.

FIGS. 22A-L show the thermal melting curves for mAb1 (FIG. 22A), mAb2 (FIG. 22B), chimeric ("xi") 7G6 ("xi7G6") (FIG. 22C), 7G6-HCzu8-LCzu6 (FIG. 22D), 7G6-HCzu8-LCzu21 (FIG. 22E), 7G6-HCzu23-LCzu15 (FIG. 22F), 7G6-HCzu24-LCzu15 (FIG. 22G), 7G6-HCzu25-LCzu15 (FIG. 22H), 7G6-HCzu23-LCzu18 (FIG. 22I), 7G6-HCzu24-LCzu18 (FIG. 22J), 7G6-HCzu25-LCzu18 (FIG. 22K), and 7G6-HCzu8-LCzu6 (FIG. 22L). F(ab')$_2$ fragments and controls were subjected to thermal analysis ranging from 25–100° C. using a scan rate of 100° C./hour. The profiles of the chimeric, 7G6-HCzu8 and 7G6-HCzu25 F(ab')$_2$ were similar to non-Tau-binding IgG1 control mAb 1 and mAb2. 7G6-HCzu23 and 7G6-HCzu24, however, contained a second peak, indicating instability of the F(ab')$_2$ fragment, possibly the dissociation of the HC-LC interaction. The transition midpoints of 7G6-HCzu8-LCzu21, 7G6-HCzu25-LCzu15, and 7G6-HCzu25-LCzu18 were similar, ranging from 77.4 to 77.6° C. The midpoint of 7G6-HCzu8-LCzu6 was one degree higher at 78.6° C.

FIGS. 23A and 23B show results of the immunoreactive T cell epitope analysis, providing putative hotspots (SEQ ID NOs: 80-94 in FIG. 23A; SEQ ID NOs: 95-111 in FIG. 23B) in humanized antibody 7G6 heavy chains. The peptides in the tables were identified as having identity 5% or less identity to human germline sequences. The percent homology of the peptides to variable domain germline sequences was also taken into consideration. Peptides with ~5% or less homology to variable region germline sequences and/or were predicted to bind three or more HLA alleles were identified as higher risk (highlighted in gray).

FIGS. 24A-24D show results of the immunoreactive T cell epitope analysis, providing putative hotspots in humanized antibody 7G6 light chains (SEQ ID NOs: 112-130 in FIG. 24A; SEQ ID NOs: 131-150 in FIG. 24B; SEQ ID NOs: 151-165 in FIG. 24C; and SEQ ID NOs: 166-180 in FIG. 24D). The peptides in the tables were identified as having identity 5% or less identity to human germline sequences. The percent homology of the peptides to variable domain germline sequences was also taken into consideration. Peptides with ~5% or less homology to variable region germline sequences and/or were predicted to bind three or more HLA alleles were identified as higher risk (highlighted in gray).

FIGS. 26A and 26B show the results of fine epitope mapping for humanized antibodies 7G6-HCzu8/LCzu6 and 7G6-HCzu25/LCzu18, respectively. Fluorescent images of the chips and resulting intensity plots show that the 7G6-HCzu8/LCzu6 (FIG. 26A) and 7G6-HCzu25/LCzu18 (FIG. 26B) antibodies both bind to two major sites on the full length Tau protein. FIG. 26A discloses SEQ ID NOS 1-37, respectively, in order of appearance. FIG. 26B discloses SEQ ID NOS 1-37, respectively, in order of appearance.

FIG. 27 shows that 7G6-HCzu25-LCzu18 antibody effectively inhibits Tau aggregation in vitro. The effect was statistically significant when comparing the IgG control and 7G6-HCzu25-LCzu18 antibody for days 1, 2, 5 and 6 following incubation at 37° C. No significance was observed on day 0 just after the reactions were initiated following heparin addition.

FIG. 28 shows that, when both antibody 7G6 and antibody 7G6-HCzu25-LCzu18 were tested according to the assay conditions provided in Example 5, both antibodies effectively inhibited Tau aggregation in vitro. The same effect size was seen between 7G6 and 7G6-HCzu25-LCzu18 antibodies.

FIG. 31A shows bound MTBR-Tau. FIG. 31B shows free MTBR-Tau. Mean±SEM. Male Cynomolgus monkey N=3 (Vehicle, 10 mg/kg, 30 mg/kg, 100 mg/kg).

DETAILED DESCRIPTION OF ILLUSTRATIVE EMBODIMENTS

Figure 1:
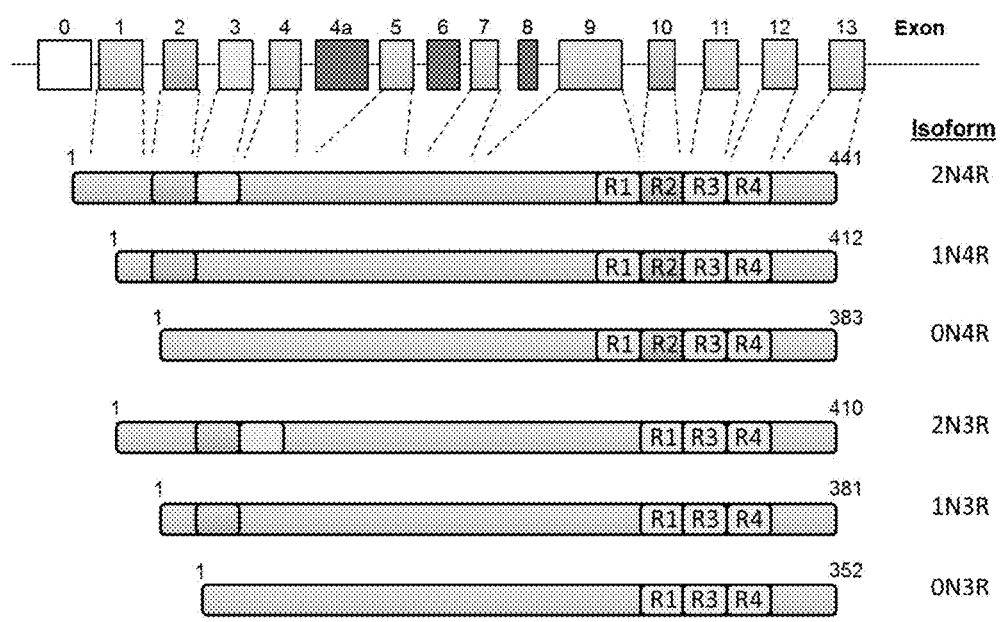
FIG. 1 illustrates the six isoforms of Tau expressed in adult human brain: 2N4R (UniProt Acc. No. P10636-8); 1N4R (UniProt Acc. No. P10636-7); 0N4R (UniProt Acc. No. P10636-6); 2N3R (UniProt Acc. No. P10636-5); 1N3R (UniProt Acc. No. P10636-4); and 0N3R (UniProt Acc. No. P10636-2) (Spillantini & Goedert, *The Lancet*, 2013, 12(6): 609-622).

The following description characterizes antibodies, and antigen-binding fragments thereof, that specifically bind to Tau. Also described are related polynucleotides capable of encoding these antibodies and antigen-binding fragments, cells expressing the antibodies and antigen-binding fragments, as well as associated vectors. In addition, methods of using the antibodies and antigen-binding fragments are described. For example, the provided antibodies, and antigen-binding fragments, may be used to treat a Tauopathy in a subject.

Various terms relating to aspects of the description are used throughout the specification and claims. Such terms are to be given their ordinary meaning in the art unless otherwise indicated. Other specifically defined terms are to be construed in a manner consistent with the definitions provided herein.

As used in this specification and the appended claims, the singular forms "a," "an," and "the" include plural referents unless the content clearly dictates otherwise. Thus, for example, reference to "a cell" includes a combination of two or more cells, and the like.

The term "about" as used herein when referring to a measurable value such as an amount, a temporal duration, and the like, is meant to encompass variations of up to ±10% from the specified value, as such variations are appropriate to perform the disclosed methods. Unless otherwise indicated, all numbers expressing quantities of ingredients, properties such as molecular weight, reaction conditions, and so forth used in the specification and claims are to be understood as being modified in all instances by the term "about." Accordingly, unless indicated to the contrary, the numerical parameters set forth in the following specification and attached claims are approximations that may vary depending upon the desired properties sought to be obtained by the present invention. At the very least, and not as an attempt to limit the application of the doctrine of equivalents to the scope of the claims, each numerical parameter should at least be construed in light of the number of reported significant digits and by applying ordinary rounding techniques.

Notwithstanding that the numerical ranges and parameters setting forth the broad scope of the invention are approximations, the numerical values set forth in the specific examples are reported as precisely as possible. Any numerical value, however, inherently contain certain errors necessarily resulting from the standard deviation found in their respective testing measurements.

"Isolated" means a biological component (such as a nucleic acid, peptide or protein) has been substantially separated, produced apart from, or purified away from other biological components of the organism in which the component naturally occurs, i.e., other chromosomal and extrachromosomal DNA and RNA, and proteins. Nucleic acids, peptides and proteins that have been "isolated" thus include nucleic acids and proteins purified by standard purification methods. "Isolated" nucleic acids, peptides and proteins that can be part of a composition and still be isolated if such composition is not part of the native environment of the nucleic acid, peptide, or protein. The term also embraces nucleic acids, peptides and proteins prepared by recombinant expression in a host cell as well as chemically synthesized nucleic acids.

"Polynucleotide," synonymously referred to as "nucleic acid molecule" or "nucleic acids," refers to any polyribonucleotide or polydeoxyribonucleotide, which may be unmodified RNA or DNA or modified RNA or DNA. "Polynucleotides" include, without limitation single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. "Polynucleotide" also embraces relatively short nucleic acid chains, often referred to as oligonucleotides.

The meaning of "substantially the same" can differ depending on the context in which the term is used. Because of the natural sequence variation likely to exist among heavy and light chains and the genes encoding them, one would expect to find some level of variation within the amino acid sequences or the genes encoding the antibodies or antigen-binding fragments described herein, with little or no impact on their unique binding properties (e.g., specificity and affinity). Such an expectation is due in part to the degeneracy of the genetic code, as well as to the evolutionary success of conservative amino acid sequence variations, which do not appreciably alter the nature of the encoded protein. Accordingly, in the context of nucleic acid sequences, "substantially the same" means at least 65% identity between two or more sequences. Preferably, the term refers to at least 70% identity between two or more sequences, more preferably at least 75% identity, more preferably at least 80% identity, more preferably at least 85% identity, more preferably at least 90% identity, more preferably at least 91% identity, more preferably at least 92% identity, more preferably at least 93% identity, more preferably at least 94% identity, more preferably at least 95% identity, more preferably at least 96% identity, more preferably at least 97% identity, more preferably at least 98% identity, and more preferably at least 99% or greater identity. Such identity may be determined using nBLAST algorithm (Altschul et al., (1990) Proc. Natl. Acad. Sci. USA 87:2264-8; Karlin and Altschul (1993) Proc. Natl. Acad. Sci. USA 90:5873-7).

The degree of variation that may occur within the amino acid sequence of a protein without having a substantial effect on protein function is much lower than that of a nucleic acid sequence, since the same degeneracy principles do not apply to amino acid sequences. Accordingly, in the context of an antibody or antigen-binding fragment, "substantially the same" means the sequences have "insubstantial differences". Insubstantial differences are substitutions of 1, 2, 3, 4, 5 or 6 amino acids in an antibody or antibody fragment amino acid sequence. Amino acid sequences substantially the same as the sequences disclosed herein are also part of this application. In some embodiments, the sequence identity can be about 90%, 91%, 92%, 93%, 94%, 95%, 96%, 97%, 98%, 99% or higher. Other embodiments include Tau-specific antibodies, or antigen-binding fragments, that have framework, scaffold, or other non-binding regions that do not share significant identity with the antibodies and antigen-binding fragments described herein, but do incorporate one or more CDRs or other sequences needed to confer binding that are 90%, 91%, 92%, 93%, 94%, 95%, 96%, 97%, 98%, or 99% identical to such sequences described herein.

A "vector" is a replicon, such as plasmid, phage, cosmid, or virus in which another nucleic acid segment may be operably inserted so as to bring about the replication or expression of the segment.

The terms "express" and "produce" are used synonymously herein, and refer to the biosynthesis of a gene product. These terms encompass the transcription of a gene into RNA. These terms also encompass translation of RNA into one or more polypeptides, and further encompass all naturally occurring post-transcriptional and post-translational modifications. The expression or production of an antibody or antigen-binding fragment thereof may be within the cytoplasm of the cell, or into the extracellular milieu such as the growth medium of a cell culture.

The term "treating" or "treatment" refers to any success or indicia of success in the attenuation or amelioration of an injury, pathology or condition, including any objective or subjective parameter such as abatement, remission, diminishing of a symptom or making the condition more tolerable to the patient, slowing in the rate of degeneration or decline, making the final point of degeneration less debilitating, improving a subject's physical or mental well-being, or prolonging the length of survival. The treatment may be assessed by objective or subjective parameters; including the results of a physical examination, neurological examination, or psychiatric evaluations. In a particular embodiment, the symptom of a Tauopathy is an impairment in cognition. In a specific embodiment, the symptom of a Tauopathy is an impairment in learning and/or memory. In a specific embodiment, the symptom of a Tauopathy is a long-term memory loss. In a specific embodiment, the symptom of a Tauopathy is dementia. In some embodiments, the symptom of a Tauopathy is confusion, irritability, aggression, mood swings, or a language impairment. In some embodiments, the symptom of a Tauopathy is an impairment or loss of one or more cognitive functions such as reasoning, situational judgment, memory capacity, and/or learning.

The term "antibody" as used herein is meant in a broad sense and includes immunoglobulin or antibody molecules including polyclonal antibodies, monoclonal antibodies including murine, human, human-adapted, humanized and chimeric monoclonal antibodies and antibody fragments. In general, antibodies are proteins or peptide chains that exhibit binding specificity to a specific antigen. Intact antibodies are heterotetrameric glycoproteins, composed of two identical light chains and two identical heavy chains. Typically, each light chain is linked to a heavy chain by one covalent disulfide bond, while the number of disulfide linkages varies between the heavy chains of different immunoglobulin isotypes. Each heavy and light chain also has regularly spaced intrachain disulfide bridges. Each heavy chain has at one end a variable domain (variable region) (VH) followed by a number of constant domains (constant regions). Each light chain has a variable domain at one end (VL) and a constant domain at its other end; the constant domain of the light chain is aligned with the first constant domain of the heavy chain and the light chain variable domain is aligned with the variable domain of the heavy chain. Antibody light chains of any vertebrate species can be assigned to one of two clearly distinct types, namely kappa (κ) and lambda (λ), based on the amino acid sequences of their constant domains.

Immunoglobulins can be assigned to five major classes or isotypes, depending upon the type of constant domain possessed by its heavy chain, namely IgA, IgD, IgE, IgG and IgM, depending on the heavy chain constant domain amino acid sequence. IgA and IgG are further sub-classified as the isotypes IgA1, IgA2, IgG1, IgG2, IgG3 and IgG4. The heavy chain constant domains that correspond to the different classes of immunoglobulins are called α, δ, ε, γ, and μ, respectively.

An immunoglobulin light chain variable region or heavy chain variable region consists of a "framework" region interrupted by three "antigen-binding sites". The antigen-binding sites are defined using various terms as follows: (i) the term Complementarity Determining Regions (CDRs) is based on sequence variability (Wu and Kabat, J. Exp. Med. 132:211-250, 1970). Generally, the antigen-binding site has six CDRs; three in the VH (HCDR1, HCDR2, HCDR3), and three in the VL (LCDR1, LCDR2, LCDR3) (Kabat et al., Sequences of Proteins of Immunological Interest, 5th Ed. Public Health Service, National Institutes of Health, Bethesda, Md., 1991). The "IMGT-CDRs" as proposed by Lefranc (Lefranc et al., Dev. Comparat. Immunol. 27:55-77, 2003) are based on the comparison of V domains from immunoglobulins and T-cell receptors. The International ImMunoGeneTics (IMGT) database (www_imgt_org) provides a standardized numbering and definition of these regions. The correspondence between CDRs and IMGT delineations is described in Lefranc et al., Dev. Comparat. Immunol. 27:55-77, 2003.

Antigen-binding fragments are any proteinaceous structure that may exhibit binding affinity for a particular antigen. Some antigen-binding fragments are composed of portions of intact antibodies that retain antigen-binding specificity of the parent antibody molecule. For example, antigen-binding fragments may comprise at least one variable region (either a heavy chain or light chain variable region) or one or more CDRs of an antibody known to bind a particular antigen. Examples of suitable antigen-binding fragments include, without limitation diabodies and single-chain molecules as well as Fab, F(ab')$_2$, Fc, Fabc, and Fv molecules, single chain (Sc) antibodies, individual antibody light chains, individual antibody heavy chains, chimeric fusions between antibody chains or CDRs and other proteins, protein scaffolds, heavy chain monomers or dimers, light chain monomers or dimers, dimers consisting of one heavy and one light chain, and the like. All antibody isotypes may be used to produce antigen-binding fragments. Additionally, antigen-binding fragments may include non-antibody proteinaceous frameworks that may successfully incorporate polypeptide segments in an orientation that confers affinity for a given antigen of interest, such as protein scaffolds. Antigen-binding fragments may be recombinantly produced or produced by enzymatic or chemical cleavage of intact antibodies. The phrase "an antibody or antigen-binding fragment thereof" may be used to denote that a given antigen-binding fragment incorporates one or more amino acid segments of the antibody referred to in the phrase.

"Specific binding" or "specifically binds" refers to the binding of an antibody or antigen-binding fragment to an antigen with greater affinity than for other antigens. Typically, the antibody or antigen-binding fragment binds to the antigen with an equilibrium dissociation constant $K_D$ of about $5\times10^{-8}$M or less, for example about $5\times10^{-9}$M or less, about $1\times10^{-9}$M or less, about $1\times10^{-8}$ M or less, or about $1\times10^{-11}$ M or less.

"Biepitopic" when used in the context of antibodies or antibody fragments refers to the ability of the antibody or fragment to specifically bind to two non-overlapping epitopes on the same target antigen molecule though not necessarily simultaneously.

The term "subject" refers to human and non-human animals, including all vertebrates, e.g., mammals and non-mammals, such as non-human primates, mice, rabbits, sheep, dogs, cats, horses, cows, chickens, amphibians, and reptiles. In many embodiments of the described methods, the subject is a human.

The embodiments described herein are not limited to particular methods, reagents, compounds, compositions or biological systems, which can, of course, vary.

Described herein are isolated monoclonal antibodies and antigen-binding fragments that specifically bind Tau, preferably human Tau ("anti-Tau antibodies"). Human Tau 2N4R (also referred to as Tau441) is set forth herein as SEQ ID NO: 181:

```
MAEPRQEFEV MEDHAGTYGL GDRKDQGGYT MHQDQEGDTD

AGLKESPLQT PTEDGSEEPG SETSDAKSTP TAEDVTAPLV

DEGAPGKQAA AQPHTEIPEG TTAEEAGIGD TPSLEDEAAG

HVTQARMVSK SKDGTGSDDK KAKGADGKTK IATPRGAAPP

GQKGQANATR IPAKTPPAPK TPPSSGEPPK SGDRSGYSSP

GSPGTPGSRS RTPSLPTPPT REPKKVAVVR TPPKSPSSAK

SRLQTAPVPM PDLKNVKSKI GSTENLKHQP GGGKVQIINK

KLDLSNVQSK CGSKDNIKHV PGGGSVQIVY KPVDLSKVTS

KCGSLGNIHH KPGGGQVEVK SEKLDFKDRV QSKIGSLDNI

THVPGGGNKK IETHKLTFRE NAKAKTDHGA EIVYKSPVVS

GDTSPRHLSN VSSTGSIDMV DSPQLATLAD EVSASLAKQG

L.
```

Human Tau also refers to Tau variants, for example, naturally occurring allelic variants, including those illustrated in FIG. 1 [2N4R (UniProt Acc. No. P10636-8); 1N4R (UniProt Acc. No. P10636-7); 0N4R (UniProt Acc. No. P10636-6); 2N3R (UniProt Acc. No. P10636-5); 1N3R (UniProt Acc. No. P10636-4); and 0N3R (UniProt Acc. No. P10636-2)], or sequences containing at least one amino acid substitution relative thereto. In some embodiments, the antibodies or antigen-binding fragments are murine IgG, or derivatives thereof. While the anti-Tau antibodies or antigen-binding fragments may be human, humanized, or chimeric, the antibodies or antigen-binding fragments exemplified herein are murine and humanized antibodies.

In any of the embodiments described herein, the antibody that specifically binds Tau is preferably IgG1, more preferably human IgG1. The antibodies and antigen-binding fragments that specifically bind Tau as disclosed in the examples section are derived from mice. Similar antibodies may be derived from any species by recombinant means. For example, the antibodies or antigen-binding fragments may be chimeric rat, goat, horse, swine, bovine, chicken, rabbit, camelid, donkey, human, and the like. For use in administration to humans, non-human derived antibodies or antigen-binding fragments may be genetically or structurally altered to be less antigenic upon administration to a human patient.

In some embodiments, the anti-Tau antibodies or antigen-binding fragments are chimeric. As used herein, the term "chimeric" refers to an antibody, or antigen-binding fragment thereof, having at least some portion of at least one variable domain derived from the antibody amino acid sequence of a non-human mammal, a rodent, or a reptile, while the remaining portions of the antibody, or antigen-binding fragment thereof, are derived from a human. For example, a chimeric antibody may comprise a mouse antigen binding domain with a human Fc or other such structural domain. Chimeric antibodies are renoted by the term "xi". In some embodiments, the antibodies or antigen-binding fragments that specifically bind Tau are humanized antibodies or fragments. Humanized antibodies may be chimeric immunoglobulins, immunoglobulin chains or fragments thereof (such as Fv, Fab, Fab', F(ab')$_2$ or other antigen-binding subsequences of antibodies) that contain minimal sequence derived from non-human immunoglobulin. For the most part, humanized antibodies are human immunoglobulins (recipient antibody) in which residues from a complementary-determining region (CDR) of the recipient are replaced by residues from a CDR of a non-human species (donor antibody) such as mouse, rat or rabbit having the desired specificity, affinity, and capacity. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin sequence. The humanized antibody may include at least a portion of an immunoglobulin constant region (Fc), typically that of a human immunoglobulin. Humanized antibody heavy or light chains are denoted herein by the term "zu".

The antibodies or antigen-binding fragments described herein can occur in a variety of forms, but will include one or more of the antibody variable domain segments or CDRs shown in Table 1.

TABLE 1

Antibody segments of the described antibodies and antigen-binding fragments thereof 7G6 VH sequences

| Clone Name (Species & Isotype) | Heavy Chain DNA Sequence | Heavy Chain Amino Acid Sequence | cDNA Leader | Variable Domain (DNA) (amino acid) | Constant Domain (DNA) (amino acid) |
|---|---|---|---|---|---|
| mouse 7G6-Vh | With leader [SEQ ID NO: 190]:<br>ATGGGATGGAGCTGTATCATCCTC<br>ATTTTGTTAGCAGCAGCTACAGGT<br>GTCCACTCCCAGGTCCAACTGCTG<br>CAGCCTGGGGCTGAGCTTGTGAAG<br>CCTGGGGCTTCAGTAATAATGTCC<br>TGCAAGGCTTCTGGCTACACCTTC<br>ACCACTACTGGATAACCTGGGTG<br>AAGCAGAGGCCTGGACAAGGCCTT<br>GAGTGGATTGGAGATATTTATCCT<br>GGTAGTAGTATTTGTAACTACAAT<br>GAGAAGTTCAAGAGCAAGGCCACA<br>CTGTGTAGACACATCTCCAGC<br>ACAGCCTACATGCAGCTCAACAGC<br>CTGACATCTGAGGACTCTGCGGTC<br>TATTACTGTGCAAGGGAGGATGGT<br>TACGACGCCTGGTTTGCTTACTGG<br>GGCCAAGGGACTCTGGTCACTGTC<br>TCCGCAGCCAAAACAACACCCCA<br>TCAGTCTATCCACTGGCCCCTGGG<br>TGTGGAGATACAACTGGTTCCTCT<br>GTGACTCTGGGATGCCTGGTCAAG<br>GGCTA<br>Without leader [SEQ ID NO: 191]:<br>CAGGTCCAACTGCTGCAGCCTGGG<br>GCTGAGCTTGTGAAGCCTGGGGCT<br>TCAGTAATAATGTCCTGCAAGGCT<br>TCTGGCTACACCTTCACCACTAC<br>TGGATAACCTGGGTGAAGCAGAGG<br>CCTGGACAAGGCCTTGAGTGGATT<br>GGAGATATTTATCCTGGTAGTAGT<br>ATTTGTAACTACAATGAGAAGTTC<br>AAGAGCAAGGCCACACTGTA<br>GACACATCTCCAGCACCCTGACATCT<br>ATGCAGCTCAACAGCCTGACATCT<br>GAGGACTCTGCGGTCTATTACTGT<br>GCAAGGGAGGATGGTTACGACGCC<br>TGGTTTGCTTACTGGGGCCAAGG<br>ACTCTGGTCACTGTCTCCGCAGCC<br>AAAACAACACCCCATCAGTCTAT<br>CCACTGGCCCCTGGGTGTGGAGAT | With leader [SEQ ID NO: 192]:<br>MGWSCIILVAAATGVHSQVQ<br>LLQPGAELVKPGASVIMSCKAS<br>GYTFTTWITWVKQRPGQGLEW<br>IGDIYPGSSICNYNEKFKSKAT<br>LTVDTSSSTAYMQLNSLTSEDS<br>AVYYCAREDGYDAWFAYWGQGT<br>LVTVSAAKTTPPSVYPLAPGCG<br>DTTGSSVTLGCLVKG<br>Without leader [SEQ ID NO: 193]:<br>QVQLQPGAELVKPGASVIMSC<br>KASGYTFTTWITWVKQRPGQG<br>LEWIGDIYPGSSICNYNEKFKS<br>KATLTVDTSSSTAYMQLNSLTS<br>EDSAVYYCAREDGYDAWFAYWG<br>QGTLVTVSAAKTTPPSVYPLAP<br>GCGDTTGSSVTLGCLVKG | ATGGGATG<br>GAGCTGTA<br>TCATCCTC<br>ATTTTGGT<br>AGCAGCAG<br>CTACAGGT<br>GTCCACTC<br>C<br>(Nucleotides 1-57 of SEQ ID NO: 190)<br>[SEQ ID NO: 194] | CAGGTCCAACTGCTGCAG<br>CCTGGGGCTGAGCTTGTG<br>AAGCCTGGGGCTTCAGTA<br>ATAATGTCCTGCAAGGCT<br>TCTGGCTACACCTTCACC<br>ACCACTGATAACCTGG<br>GTGAAGCAGAGGCCTGGA<br>CAAGGCCTTGAGTGGATT<br>GGAGATATTTATCCTGGT<br>AGTAGTATTTGTAACTAC<br>AATGAGAAGTTCAAGAGC<br>AAGGCCACACTGACTGTA<br>GACACATCTCCAGCACA<br>GCCTACATGCAGCTCAAC<br>AGCCTGACATCTGAGGAC<br>TCTGCGGTCTATTACTGT<br>GCAAGGGAGGATGGTTAC<br>GACGCCTGGTTTGCTTAC<br>TGGGGCCAAGGGACTCTG<br>GTCACTGTCTCCGCA<br>(Nucleotides 58 to 414 of SEQ ID NO: 190)<br>[SEQ ID NO: 195]<br>QVQLQPGAELVKPGASV<br>IMSCKASGYTFTTWITW<br>VKQRPGQGLEWIGDIYPG<br>SSICNYNEKFKSKATLTV<br>DTSSSTAYMQLNSLTSED<br>SAVYYCAREDGYDAWFAY<br>WGQGTLVTVSA<br>[SEQ ID NO: 196] | GCCAAAACAACACCCCCA<br>TCAGTCTATCCACTGGCC<br>CCTGGGTGTGGAGATACA<br>ACTGGTTCCTCTGTGACT<br>CTGGGATGCCTGGTCAAG<br>GGCTA<br>(Nucleotides 415 to 509 of SEQ ID NO: 190)<br>[SEQ ID NO: 197]<br>AKTTPPSVYPLAPGCGDT<br>TGSSVTLGCLVKG<br>[SEQ ID NO: 198] |

TABLE 1-continued

| | | | |
|---|---|---|---|
| | ACAACTGGTTCCTCTGACTCTG<br>GGATGCCTGGTCAAGGGCTA | | |
| 7G6-HCzu1 | With leader [SEQ ID NO: 199]:<br>ATGGGCTGGTCCTGCCATCCTG<br>TTTCTGGTGGCCACCGCCGGC<br>GTGCACAGCCAGGTGCAGCTGGTG<br>CAGTCTGGCGCCGAAGTGAAGAAA<br>CCTGGGGCCTCCGTGAAGGTGTCC<br>TGCAAGGCTTCCGGCTACACCTTT<br>ACCACTACTGGATCACCTGGGTG<br>CGACAGGCTCCTGGACAGGGCCTG<br>GAATGGATGGGCGACATCTACCCC<br>GGCTCCATCTGCAACTACAAC<br>GAGAAGTTCAAGTCCCGCGTGACC<br>ATGACCCGGGACACCTCCACCAGC<br>ACCGTGTACATGGAACTGTCCTCC<br>CTGCGGAGCGAGGACACCGCCGTG<br>TACTACTGCGCTAGAGAGGACGGC<br>TACGACGTTGGTTTGCCTACTGG<br>GGCCAGGGCACCCTCGTGACCGTG<br>TCATCTGGCGGAGGAGGATCAACAC<br>TCGGTTCTCCCCCCTGGGGCACC<br>TCCAAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC<br>GTGCCCTCCAGCAGCTTGGGCACC<br>CAGACCTACATCTGCAACGTGAAT<br>CACAAGCCCAGCAACACCAAGGTG<br>GACAAGAAAGTTGAGCGCAAATCT<br>TGTGACAAAACTCACACACA<br>TGCCCACCGTGCCCAGCACCT<br>GAACTCCTGGGGGGA<br>CCGTCAGTCTTCCTCTTC<br>CCCCCAAAACCCAAGGACACCCTC<br>ATGATCTCCCGGACCCCTGAGGTC<br>ACATGCGTGGTGGACGTGAGC<br>CACGAAGACCCTGAGGTCAAGTTC<br>AACTGGTACGTGGACGGCGTGGAG<br>GTGCATAATGCCAAGACAAAGCCG<br>CGGGAGGAGCAGTACAACAGCACG<br>TACCGTGTGGTCAGCGTCCTCACC<br>GTCCTGCACCAGGACTGGCTGAAT<br>GGCAAGGAGTACAAGTGCAAGGTC<br>TCCAACAAAGCCCTCCCAGCCCC<br>ATCGAGAAAACCATCTCCAAAGCC<br>AAAGGGCAGCCCCGAGAACCACAG<br>GTGTACACCCTGCCCCCATCCCGG<br>GATGAGCTGACCAAGAACCAGGTC | ATGGGCTG<br>GTCCTGCA<br>TCATCCTG<br>TTTCTGT<br>GGCCACCG<br>CCACCGGC<br>GTGCACAG<br>C<br>(Nucleotides<br>1<br>to 57 of<br>SEQ ID<br>NO: 199) | ATGGGCTGGTCCTGCATC<br>ATCCTGTTTCTGGTGGCC<br>ACCGCCACCGGCGTGCAC<br>AGCCAGGTGCAGCTGGTG<br>CAGTCTGGCGCCGAAGTG<br>AAGAAACCTGGCGCCTCC<br>GTGAAGGTGTCCTGCAAG<br>GCTTCCGGCTACACCTTT<br>ACCACTACTGGATCACC<br>TGGGTGCGACAGGCTCCT<br>GGACAGGGCCTGGAATGG<br>ATGGGCGACATCTACCCC<br>GGCTCCATCTGCAAC<br>TACAACGAGAAGTTCAAG<br>TCCCGCGTGACCATGACC<br>CGGGACACCTCCACCAGC<br>ACCGTGTACATGGAACTG<br>TCCTCCCTGCGGAGCGAG<br>GACACCGCCGTGTACTAC<br>TGCGCTAGAGAGGACGGC<br>TACGACGTTGGTTTGCC<br>TACTGGGGCCAGGGCACC<br>CTCGTGACCGTGTCATCT<br>(Nucleotides 58 to<br>414 of SEQ ID NO:<br>199)<br>[SEQ ID NO: 204]<br>QVQLVQSGAEVKKPGASV<br>KVSCKASGYTFTTYWITW<br>VRQAPGQGLEWMGDIYPG<br>SSICNYNEKFKSRVTMTR<br>DTSTSTVYMELSSLRSED<br>TAVYYCAREDGYDWFAY<br>WGQGTLVTVSS<br>[SEQ ID NO: 205] | GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGGA<br>CCGTCAGTCTTCCTCTTC<br>CCCCCAAAACCCAAGGAC<br>ACCCTCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT<br>AATGCCAAGACAAAGCCG<br>CGGGAGGAGCAGTACAAC<br>AGCACGTACCGTGTGGTC<br>AGCGTCCTCACCGTCCTG<br>CACCAGGACTGGCTGAAT<br>GGCAAGGAGTACAAGTGC<br>AAGGTCTCCAACAAAGCC<br>CTCCCAGCCCCCATCGAG<br>AAAACCATCTCCAAAGCC<br>AAAGGGCAGCCCCGAGAA<br>CCACAGGTGTACACCCTG<br>CCCCCATCCCGGGATGAG<br>CTGACCAAGAACCAGGTC<br>AGCCTGACCTGCCTGGTC<br>AAAGGCTTCTATCCCAGC<br>GACATCGCCGTGGAGTGG<br>GAGAGCAATGGGCAGCCG<br>GAGAACAACTACAAGACC<br>ACGCCTCCCGTGCTGGAC<br>TCCGACGGCTCCTTCTTC<br>TTATATTCAAAGCTCACC<br>GTGGACAAGAGCAGGTGG |

TABLE 1-continued

| | |
|---|---|
| AGCTGACTGCTGCCTGGTCAAAGGC<br>TTCTATCCCAGCACATGCCGTG<br>GAGTGGGAGCAATAAGACCAGCCG<br>GAGAACAACTACAAGACCACGCCT<br>CCCGTGCTGGACTCCGACGGCTCC<br>TTCTTCTTATATTCAAAGCTCACC<br>GTGGACAAGAGCAGGTGGCAGCAG<br>GGGAAGGTCTTCTCATGCTCCGTG<br>ATGCATGAGGCTCTGCACAACCAC<br>TACACGCAGAAGAGCCCTCTCCCTG<br>TCTCCGGGAAATGA<br>Without leader [SEQ ID<br>NO: 200]<br>CAGGTGCAGCTGGTGCAGTCTGGC<br>GCCGAAGTGAAGAAACCTGGCGCC<br>TCCGTGAAGGTGTCCTGCAAGGCT<br>TCCGGCTACACCTTTACCACCTAC<br>TGGATCACCTGGGTGCGACAGGCT<br>CCTGGACAGGGCCTGGAATGGATG<br>GGCGACATCTACCCCGGCTCCTCC<br>ATCTGCAACTACAACGAGAAGTTC<br>AAGTCCCGGGTGACCATGACCCGG<br>GACACCTCCACCAGCACCGTGTAC<br>ATGGAACTGTCCTCTCTGCGGAGC<br>GAGGACACCGCCGTGTACTACTGC<br>GCTAGAGAGGACCGGTACGACGCT<br>TGGTTTGCCTACTGGGGCCAGGGC<br>ACCCTCGTGACCGTGTCATCTGCA<br>TCCACCAAGGGCCCATCCGTCTTC<br>CCCCTGGCACCCTCTCCAAGAGC<br>ACCTCTGGGGGCACAGCGGCCCTG<br>GGCTGCCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTA<br>CAGTCCTCAGGACTCTACTCCCTC<br>AGCAGCGTGGTGACCGTGCCCTCC<br>AGCAGCTTGGGCACCCAGACCTAC<br>ATCTGCAACGTGAATCACAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCTGGGGGGACCG<br>TCAGTCTTCCTCTTCCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG | CAGCAGGGGAACGTCTTC<br>TCATGCTCCGTGATGCAT<br>GAGGCTCTGCACAACCAC<br>TACACGCAGAAGAGCCTC<br>TCCCTGTCTCCGGG<br>(Nucleotides 415<br>to 1401 of SEQ ID<br>NO: 199)<br>[SEQ ID NO: 206]<br>ASTKGPSVFPLAPSSKST<br>SGGTAALGCLVKDYFPEP<br>VTVSWNSGALTSGVHTFP<br>AVLQSSGLYSLSSVVTVP<br>SSSLGTQTYICNVNHKPS<br>NTKVDKKVEPKSCDKTHT<br>CPPCPAPELLGGPSVFLF<br>PPKPKDTLMISRTPEVTC<br>VVVDVSHEDPEVKFNWYV<br>DGVEVHNAKTKPREEQYN<br>STYRVVSVLTVLHQDWLN<br>GKEYKCKVSNKALPAPIE<br>KTISKAKGQPREPQVYTL<br>PPSRDELTKNQVSLTCLV<br>KGFYPSDIAVEWESNGQP<br>ENNYKTTPPVLDSDGSFF<br>LYSKLTVDKSRWQQGNVF<br>SCS<br>[SEQ ID NO: 207] |

TABLE 1-continued

| | | | |
|---|---|---|---|
| | TACAAGTGCAAGGTCTCCAACAAA<br>GCCCTCCCAGCCCCCATGGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCTTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | | |
| 7G6-<br>HCzu2 | With leader [SEQ ID<br>NO: 208]:<br>ATGGGCTGGTCCTGCATCATCCTG<br>TTTCTGGTGGCCACCGGCCACCGGC<br>GTGCACAGCCAGGTGCAGCTGGTG<br>CAGTCTGGCGCCCTCCGTGAAGGTGTCC<br>CCTGGCGCCTCCGTGAAGGTGTCC<br>TGCAAGGCTTCCGGCTACACCTTT<br>ACCACCTACTGGATCACCTGGGTG<br>CGACAGGCTCCTGGACAGGGCCTG<br>GAATGGATGGGCGACATCTACCCC<br>GGCTCCTCCATCTGCAACTACAAC<br>GAGAAGTTCAAGTCCCGCGTGACC<br>ATGACCGTGGACACCTCCACCAGC<br>ACCGTGTACATGGAACTGTCCTCC<br>CTGCGGAGCGAGGACACCGCCGTG<br>TACTACTGCGCTAGAGAGGACGGC<br>TACGACGCTTGGTTTGCCTACTGG<br>GGCCAGGGCACCCTCGTGACCGTG<br>TCATCTGCATCCACCAAGGGCCCA<br>TCGGTCTTCCCCCTGGCACCCTCC<br>TCCAAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC<br>GTGCCCTCCAGCAGCTTGGGCACC<br>CAGACCTACATCTGCAACGTGAAT<br>CACAAGCCCAGCAACACCAAGGTG<br>GACAAGAAAGTTGAGCCCAAATCT<br>TGTGACAAAACTCACACATGCCCA<br>CCGTGCCCAGCACCTGAACTCCTG<br>GGGGGACCGTCAGTCTTCCTCTTC | With leader [SEQ ID<br>NO: 210]:<br>MGWSCIILFLVATATGVHSQVQ<br>LVQSGAEVKKPGASVKVSCKAS<br>GYTFTTYWITWVRQAPGQGLEW<br>MGDIYPGSSICNYNEKFKSRVT<br>MTVDTSTSTVYMELSSLRSEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br>Without leader [SEQ ID<br>NO: 211]:<br>QVQLVQSGAEVKKPGASVKVSC<br>KASGYTFTTYWITWVRQAPGQG<br>LEWMGDIYPGSSICNYNEKFKS<br>RVTMTVDTSTSTVYMELSSLRS<br>EDTAVYYCAREDGYDAWFAYWG<br>QGTLVTVSSASTKGPSVFPLAP<br>SSKSTSGGTAALGCLVHTFPAV<br>PVTVSWNSGALTSGVHTFPAVL<br>QSSGLYSLSSVVTVPSSSLGTQ | ATGGGCTG<br>GTCCTGCA<br>TCATCCTG<br>TTTCTGGT<br>GGCCACCG<br>CCACCGGC<br>GTGCACAG<br>C<br>(Nucleotides<br>1 to 57)<br>[SEQ ID<br>NO: 212]<br>CAGGTGCAGCTGGTGCAG<br>TCTGGCGCCCAAGTGAAG<br>AAACCTGGCGCCTCCGTG<br>AAGGTGTCCTGCAAGGCT<br>TCCGGCTACACCTTTACC<br>ACCTACTGGATCACCTGG<br>GTGCGACAGGCTCCTGGA<br>CAGGGCCTGGAATGGATG<br>GGCGACATCTACCCCGGC<br>TCCTCCATCTGCAACTAC<br>AACGAGAAGTTCAAGTCC<br>CGCGTGACCATGACCGTG<br>GACACCTCCACCAGCACC<br>GTGTACATGGAACTGTCC<br>TCCCTGCGGAGCGAGGAC<br>ACCGCCGTGTACTACTGC<br>GCTAGAGAGGACGGCTAC<br>GACGCTTGGTTTGCCTAC<br>TGGGGCCAGGGCACCCTC<br>GTGACCGTGTCATCT<br>(Nucleotides 58 to<br>414 of SEQ ID NO:<br>208)<br>[SEQ ID NO: 213]<br>QVQLVQSGAEVKKPGASV<br>KVSCKASGYTFTTYWITW<br>VRQAPGQGLEWMGDIYPG<br>SSICNYNEKFKSRVTMTV<br>DTSTSTVYMELSSLRSED<br>TAVYYCAREDGYDAWFAY<br>WGQGTLVTVSS<br>[SEQ ID NO: 214] | GCATCTACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGGA<br>CCGTCAGTCTTCCTCTTC<br>CCCCCAAAACCAAGGAC<br>ACCCTCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT<br>AATGCAAAGACAAGCCG<br>CGGGAGGAGCAGTACAAC<br>AGCACGTACCGTGTGGTC<br>AGCGTCCTCACCGTCCTG<br>CACCAGGACTGGCTGAAT<br>GGCAAGGAGTACAAGTGC<br>AAGGTCTCCAACAAGGCC |

TABLE 1-continued

| | | |
|---|---|---|
| CCCCAAAACCCAAGGACACCCTC | TYICNVNHKPSNTKVDKKVEPK | CTCCCAGCCCCCATCGAG |
| ATGATCTCCCGGACCCCTGAGGTC | SCDKTHTCPPCPAPELLGGPSV | AAAACCATCTCCAAGGCC |
| ACATCCGTGGTGGACGTGAGC | FLFPPKPKDTLMISRTPEVTCV | AAAGGCCAGCCCCGAGAA |
| CACGAAGACCCTGAGGTCAAGTTC | VVDVSHEDPEVKFNWYVDGVEV | CCCAGAGTGTACACCCTG |
| AACTGGTACGTGGACGGCGTGGAG | HNAKTKPREEQYNSTYRVVSVL | CCCCCATCCGGGATGAG |
| GTGCATAATGCCAAGACAAAGCCG | TVLHQDWLNGKEYKCKVSNKAL | CTGACCAAGAACCAGGTC |
| CGGGAGGAGCAGTACAACAGCACG | PAPIEKTISKAKGQPREPQVYT | AGCCTGACCTGCCTGGTC |
| TACCGTGTGGTCAGCGTCCTCACC | LPPSRDELTKNQVSLTCLVKGF | AAAGGCTTCTATCCCAGC |
| GTCCTGCACCAGGACTGGCTGAAT | YPSDIAVEWESNGQPENNYKTT | GACATCGCCGTGGAGTGG |
| GGCAAGGAGTACAAGTGCAAGGTC | PPVLDSDGSFFLYSKLTVDKSR | GAGAGCAATGGGCAGCCG |
| TCCAACAAAGCCCTCCCAGCCCCC | WQQGNVFSCSVMHEALHNHYTQ | GAGAACAACTACAAGACC |
| ATCGAGAAAACATCTCCAAAGCC | KSLSLSPGK | ACGCCTCCCGTGCTGGAC |
| AAAGGGCAGCCCCGAGAACCACAG | | TCCGACGGCTCCTTCTTC |
| GTGTACACCCTGCCCCCATCCCGG | | TTATATTCAAAGCTTCACC |
| GATGAGCTGACCAAGAACCAGGTC | | GTGGACAAGAGCAGGTGG |
| AGCCTGACCTGCCTGGTCAAAGGC | | CAGCAGGGAACGTCTTC |
| TTCTATCCCAGCGACATCGCCGTG | | TCATGCTCCGTGATGCAT |
| GAGTGGGAGAGCAATGGGCAGCCG | | GAGGCTCTGCACAACCAC |
| GAGAACAACTACAAGACCACGCCT | | TACACGCAGAAGAGCCTC |
| CCCGTGCTGGACTCCGACGGCTCC | | TCCCTGTCTCCGGG |
| TTCTTCTTATATTCAAAGCTCACC | | (Nucleotides 415 to |
| GTGGACAAGAGCAGGTGGCAGCAG | | 1401 of SEQ ID NO: |
| GGGAACGTCTTCTCATGCTCCGTG | | 208) [SEQ ID NO: |
| ATGCATGAGGCTCTGCACAACCAC | | 215] |
| TACACGCAGAAGAGCCTCTCCCTG | | ASTKGPSVFPLAPSSKST |
| TCTCCGGGAAATGA | | SGGTAALGCLVKDYFPEP |
| Without leader [SEQ ID | | VTVSWNSGALTSGVHTFP |
| NO: 209]: | | AVLQSSGLYSLSSVVTVP |
| CAGGTGCAGCTGGTGCAGTCTGGC | | SSSLGTQTYICNVNHKPS |
| GCCGAAGTGAAGAAACCTGGCGCC | | NTKVDKKVEPKSCDKTHT |
| TCCGTGAAGGTGTCCTGCAAGGCT | | CPPCPAPELLGGPSVFLF |
| TCCGGCTACACCTTTACCACCTAC | | PPKPKDTLMISRTPEVTC |
| TGGATCACCTGGGTGCGACAGGCT | | VVDVSHEDPEVKPNWYV |
| CCTGGACAGGGCCTGGAATGGATG | | DGVEVHNAKTKPREEQYN |
| GGGACATCTACCCCGGCTCCTCC | | STYRVVSVLTVLHQDWLN |
| ATCTGCAACTACAACGAGAAGTTC | | GKEYKCKVSNKALPAPIE |
| AAGTCCCGCGTGACCATGACCGTG | | KTISKAKGQPREPQVYTL |
| GACACCTCCACCAGCACCGTGTAC | | PPSRDELTKNQVSLTCLV |
| ATGGAACTGTCCTCCCTGCGGAGC | | KGFYPSDIAVEWESNGQP |
| GAGGACACCGGTGACGGTGTG | | ENNYKTTPPVLDSDGSFF |
| AACTCAGGGCGCCCTGACCAGGGC | | LYSKLTVDKSRWQQGNVF |
| GTGCACACCTTCCCGGCTGTCCTA | | SCSVMHEALHNHYTQKSL |
| CAGTCCTCAGGACTCTACTCCCTC | | SLSPGK |
| AGCAGCGTGGTGACCGTGCCCTCC | | [SEQ ID NO: 216] |
| AGCAGCTTGGGCACCCAGACCTAC | | |

TABLE 1-continued

| | | |
|---|---|---|
| | ATCTGCAACGTGAATCAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCCTGGGGGGACCG<br>TCAGTCTTCCTCTTCCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAACCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCCTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | With leader [SEQ ID NO: 219]:<br>MGWSCIILFLVATATGVHSQVQ<br>LVQSGAEVKKPGASVKVSCKAS<br>GYTFTTYWITWVRQAPGQGLEW<br>MGDIYPGSSICNYNEKFKSRVT<br>MTVDTSTAYMELSSLRSEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS | CAGGTGCAGCTGGTGCAG<br>TCTGGCGCCGAAGTGAAG<br>TCGGTCTTCCCCCCTGGCA<br>AAACCTGGCGCCCTCCGTG<br>TCCGGCTACACCTTTACC<br>ACTTACTGGATCACCTGG<br>GTGCGACAGGCTCCTGGA<br>CAGGGCCTGGAATGGATG<br>GGCGACATTACCCCGGC<br>TCCTCCATCTGCAACTAC<br>AACGAGAAGTTCAAGTCC<br>CGCGTGACCATGACCGTG<br>GACACCTCCACCGCCACC<br>GCCTACATGGAACTGTCC<br>TCCCTGCGGAGCGAGGAC<br>ACCGCCGTGTACTACTGC<br>GCTAGAGAGGACGGCTAC<br>GACGCTTGGTTTGCCTAC<br>TGGGGCCAGGGCACCCTC<br>GTGACCGTGTCATCT | GCATCCACCAAGGGCCCA<br>CCCTCCTCCAAGAGCACC<br>AAGGTGTCTGCAAGGCT<br>TCTGGGGCACAGCGGCC<br>CTGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAAC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGA |
| 7G6-HCzu3 | With leader [SEQ ID NO: 217]:<br>ATGGGCTGTCCTGCATCATCCTG<br>TTTCTGGTGGCCACCGCCACCGGC<br>GTGCACAGCCAGGTGCAGCTGGTG<br>CAGTCTGGCGCCGAAGTGAAGAAA<br>CCTGGCGCCTCCGTGAAGGTGTCC<br>TGCAAGGCTTCCGGCTACACCTTT<br>ACCACCTACTGGATCACCTGGGTG<br>CGACAGGCTCCTGGACAGGGCCTG<br>GAATGGATGGGCGACATCTACCCC<br>GGCTCCTCCATCTGCAACTACAAC<br>GAGAAGTTCAAGTCCCGCGTGACC<br>ATGACCGTGACACCTCCACCAGC<br>ACCGCCTACATGGAACTGTCCTCC<br>CTGCGGAGCGAGGACACCGCCGTG<br>TACTACTGCGCTAGAGAGGACGGC<br>TACGACGCTTGGTTTGCCTACTGG<br>GGCCAGGGCACCCTCGTGACCGTG<br>TCATCTGCATCCACCAAGGGCCCA | With leader [SEQ ID NO: 217]:<br>MGWSCIILFLVATATGVHSQVQ<br>LVQSGAEVKKPGASVKVSCKAS<br>GYTFTTYWITWVRQAPGQGLEW<br>MGDIYPGSSICNYNEKFKSRVT<br>MTVDTSTAYMELSSLRSEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS | ATGGGCTG<br>GTCCTGCA<br>TCATCCTG<br>TTTCTGGT<br>GGCCACCG<br>CCACCGGC<br>GTGCACAG<br>C (Nucleotide 1 to 57 of SEQ ID NO: 217) [SEQ ID NO: 221] | |

TABLE 1-continued

| | | |
|---|---|---|
| TCGGTCTTCCCCCTGGCACCCTCC<br>TCCAAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC<br>GTGCCCTCCAGCAGCTTGGGCACC<br>CAGACCTACATCTGCAACGTGAAT<br>CACAAGCCCAGCAACACCAAGGTG<br>GACAAGAAAGTTGAGCCCAAATCT<br>TGTGACAAAACTCACACATGCCCA<br>CCGTGCCCAGCACCTGAACTCCTG<br>GGGGGACCGTCAGTCTTCCTCTTC<br>CCCCCAAAACCCAAGGACACCCTC<br>ATGATCTCCCGGACCCCTGAGGTC<br>ACATGCGTGGTGGTGGACGTGAGC<br>CACGAAGACCCTGAGGTCAAGTTC<br>AACTGGTACGTGGACGGCGTGGAG<br>GTGCATAATGCCAAGACAAAGCCG<br>CGGGAGGAGCAGTACAACAGCACG<br>TACCGTGTGTCAGCGTCCTCACC<br>GTCCTGCACCAGGACTGGCTGAAT<br>GGCAAGGAGTACAAGTGCAAGGTC<br>TCCAACAAAGCCCTCCCAGCCCC<br>ATCGAGAAAACCATCTCCAAAGCC<br>AAAGGGCAGCCCCGAGAACCACAG<br>GTGTACACCCTGCCCCCATCCCGG<br>GATGAGCTGACCAAGAACCAGGTC<br>AGCCTGACCTGCCTGGTCAAAGGC<br>TTCTATCCCAGCGACATCGCCGTG<br>GAGTGGGAGAGCAATGGCCAGCCG<br>GAGAACAACTACAAGACCACGCCT<br>CCCGTGCTGGACTCCGACGGCTCC<br>TTCTTCCTATATTCAAAGCTCACC<br>GTGGACAAGAGCAGGTGGCAGCAG<br>GGGAACGTCTTCTCATGCTCCGTG<br>ATGCATGAGGCTCTGCACAACCAC<br>TACACGCAGAAGAGCCTCTCCCTG<br>TCTCCGGGTAAATGA<br>Without leader [SEQ ID<br>NO: 218]:<br>CAGGTGCAGCTGGTGCAGTCTGGC<br>GCCGAAGTGAAGAAACCTGGCGCC<br>TCCGTGAAGGTGTCCTGCAAGGCT<br>TCCGGCTACACCTTTACCACCTAC<br>TGGATCACCTGGGTGCGACAGGCT<br>CCTGGACAGGGCCTGGAATGGATG<br>GGCGACATCTACCCCGGCTCCTCC<br>ATCTGCAACTACAACGAGAAGTTC<br>AAGTCCCACGTGACCATGACCGTG<br>GACACCTCCACCAGCACCGCCTAC | DIAVEWESNGQPENNYKTPPV<br>LDSDGSFFLYSKLTVDKSRWQQ<br>GNVFSCSVMHEALHNHYTQKSL<br>SLSPGK<br>Without leader [SEQ ID<br>NO: 220]:<br>QVQLVQSGAEVKKPGASVKVSC<br>KASGYTFTTYWITWVRQAPGQG<br>LEWMGDIYPGSSICNYNEKFKS<br>RVTMTVDTSTSTAYMELSSLRS<br>EDTAVYYCAREDGYDAWFAYWG<br>QGTLVTVSSASTKGPSVFPLAP<br>SSKSTSGGTAALGCLVKDYFPE<br>PVTVSWNSGALTSGVHTFPAVL<br>QSSGLYSLSSVVTVPSSSLGTQ<br>TYICNVNHKPSNTKVDKKVEPK<br>SCDKTHTCPPCPAPELLGGPSV<br>FLFPPKPKDTLMISRTPEVTCV<br>VVDVSHEDPEVKFNWYVDGVEV<br>HNAKTKPREEQYNSTYRVVSVL<br>TVLHQDWLNGKEYKCKVSNKAL<br>PAPIEKTISKAKGQPREPQVYT<br>LPPSRDELTKNQVSLTCLVKGF<br>YPSDIAVEWESNGQPENNYKTT<br>PPVLDSDGSFFLYSKLTVDKSR<br>WQQGNVFSCSVMHEALHNHYTQ<br>KSLSLSPGK | (Nucleotides 58 to<br>414 of SEQ ID NO:<br>217)<br>[SEQ ID NO: 222]<br>QVQLVQSGAEVKKPGASV<br>KVSCKASGYTFTTYWITW<br>VRQAPGQGLEWMGDIYPG<br>SSICNYNEKFKSRVTMTV<br>DTSTSTAYMELSSLRSED<br>TAVYYCAREDGYDAWFAY<br>WGQGTLVTVSS<br>[SEQ ID NO: 223] | CCGTCAGTCTTCCTCTTC<br>CCCCCAAAACCCAAGGAC<br>ACCCTCATGATCTCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT<br>AATGCCAAGACAAAGCCG<br>CGGGAGGAGCAGTACAAC<br>AGCACGTACCGTGTGGTC<br>AGCGTCCTCACCGTCCTG<br>CACCAGGACTGGCTGAAT<br>GGCAAGGAGTACAAGTGC<br>AAGGTCTCCAACAAAGCC<br>CTCCCAGCCCCCATCGAG<br>AAAACCATCTCCAAAGCC<br>AAAGGGCAGCCCCGAGAA<br>CCACAGGTGTACACCCTG<br>CCCCCATCCCGGGATGAG<br>CTGACCAAGAACCAGGTC<br>AGCCTGACCTGCCTGGTC<br>AAAGGCTTCTATCCCAGC<br>GACATCGCCGTGGAGTGG<br>GAGAGCAATGGCCAGCCG<br>GAGAACAACTACAAGACC<br>ACGCCTCCCGTGCTGGAC<br>TCCGACGGCTCCTTCTTC<br>TTATATTCAAAGCTCACC<br>GTGGACAAGAGCAGGTGG<br>CAGCAGGGGAACGTCTTC<br>TCATGCTCCGTGATGCAT<br>GAGGCTCTGCACAACCAC<br>TACACGCAGAAGAGCCTC<br>TCCCTGTCTCCGGG<br>(Nucleotides 415<br>to 1401 of SEQ ID<br>NO: 217)<br>[SEQ ID NO: 224]<br>ASTKGPSVFPLAPSSKST<br>SGGTAALGCLVKDYFPEP<br>VTVSWNSGALTSGVHTFP<br>AVLQSSGLYSLSSVVTVP<br>SSSLGTQTYICNVNHKPS<br>NTKVDKKVEPKSCDKTHT<br>CPPCPAPELLGGPSVFLF<br>PPKPKDTLMISRTPEVTC<br>VVVDVSHEDPEVKFNWYV<br>DGVEVHNAKTKPREEQYN<br>STYRVVSVLTVLHQDWLN<br>GKEYKCKVSNKALPAPIE<br>KTISKAKGQPREPQVYTL<br>PPSRDELTKNQVSLTCLV |

TABLE 1-continued

ATGAACTGTCCTCCTGCGAGC
GAGGACACCGCCCGTGTACTACTGC
GCTAGAGAGGACGGCTACTACGCT
TGGTTTGCCTACTGGGGCCAGGGC
ACCCTCGTGACCGTGTCATCTGCA
TCCACCAAGGGCCCATCCTGGTCTTC
CCCCTGGCACCCTCTCCAAGAGC
ACCTCTGGGGGCACAGCGGCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCCTGGGGGGACCG
TCAGTCTTCCTCTTCCCCCCCAAAA
CCCAAGGACACCCTCATGATCTCC
CGGACCCCTGAGGTCACATGCGTG
GTGGTGGACGTGAGCCACGAAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC
CAGGACTGGCTGAATGGCAAGGAG
TACAAGTGCAAGGTCTCCAACAAA
GCCCTCCCAGCCCCCATCGAGAAA
ACCATCTCCAAAGCCAAAGGGCAG
CCCCGAGAACCACAGGTGTACACC
CTGCCCCCATCCCGGGATGAGCTG
ACCAAGAACCAGGTCAGCCTGACC
TGCCTGGTCAAAGGCTTCTATCCC
AGCGACATCGCCGTGGAGTGGGAG
AGCAATGGGCAGCCGGAGAACAAC
TACAAGACCACGCCTCCCGTGCTG
GACTCCGACGGCTCCTTCTTCCTCTA
TATTCAAAGCTCACCGTGGACAAG
AGCAGGTGGCAGCAGGGGAACGTC
TTCTCATGCTCCGTGATGCATGAG
GCTCTGCACAACCACTACACGCAG
AAGAGCCTCTCCCTGTCTCCGG
GAAATGA

KGFYPSDIAVEWESNGQP
ENNYKTTPPVLDSDGSFF
LYSKLTVDKSRWQQGNVF
SCSVMHEALHNHYTQKSL
SLSPGK
[SEQ ID NO: 225]

7G6-
HCzu4

With leader [SEQ ID NO: 226]:
ATGGGCTGTCTGCATCATCCTG
TTTCTGGTGGCCACCGCCGGC
GTGCACAGCCAGGTGCAGCTGGTG With leader [SEQ ID NO: 228]:
MGWSCIILFLVATATGVHSQVQ
LVQSGAEVKKPGASVKVSCKAS
GYTFTTYWITWVRQAPGQGLEW

ATGGGCTG
GTCCTGCA
TCATCCTG
TTTCTGGT
GGCCACCG

CAGGTGCAGCTGGTGCAG
TCTGGCGCCGAAGTGAAG
AAACTGGCCGCCTCCGTG
AAGGTGTCCTGCAAGGCT
TCCGGCTACACCTTTACC

GCATCCACCAAGGGCCCA
TCGGTCTTCCCCCTGGCA
CCCTCCTCCAAGAGCACC
TCTGGGGGCACAGCGGCC
CTGGGCTGCCTGGTCAAG

TABLE 1-continued

| | | |
|---|---|---|
| CAGTCTGCGCCGCCGAAGTGAAGAAA | MGDIYPGSSICNYAQKFQGRVT | CCACCGGC |
| CCTGGCGCCTCCGTGAAGGTGTCC | MTVDTSTSTAYMELSSLRSEDT | GTGCACAG |
| TGCAAGGCTTCCGGCTACACCTTT | AVYYCAREDGYDAWFAYWGQGT | C |
| ACCACCTACTGGATCACCTGGGTG | LVTVSSASTKGPSVFPLAPSSK | (Nucleotide |
| CGACAGGCTCCTGGACAGGGCCTG | STSGGTAALGCLVKDYFPEPVT | 1 to |
| GAATGGATGGGCGACATCTACCCC | VSWNSGALTSGVHTFPAVLQSS | 57 of |
| GGCTCCTCCATCTGCAACTACGCC | GLYSLSSVVTVPSSSLGTQTYI | SEQ ID |
| CAGAAATTCCAGGGCAGAGTGACC | CNVNHKPSNTKVDKKVEPKSCD | NO: 226) |
| ATGACCGTGGACACCTCCACCAGC | KTHTCPPCPAPELLGGPSVFLF | [SEQ ID |
| ACCGCCTACATGGAACTGTCCTCC | PPKPKDTLMISRTPEVTCVVVD | NO: 230] |
| CTGCGGAGCGAGGACACCGCCGTG | VSHEDPEVKFNWYVDGVEVHNA | |
| TACTACTGCGCTAGAGAGGACGGC | KTKPREEQYNSTYRVVSVLTVL | |
| TACGACGCTTGGTTTGCCTACTGG | HQDWLNGKEYKCKVSNKALPAP | |
| GGCCAGGGCACCCTCGTGACCGTG | IEKTISKAKGQPREPQVVTLPP | |
| TCATCTGCATCCACCAAGGGCCCA | SRDELTKNQVSLTCLVKGFYPS | |
| TCGGTTCTTCCCCTGGCACCCTCC | DIAVEWESNGQPENNYKTTPPV | |
| TCCAAGAGCACCTCTGGGGGCACA | LDSDGSFFLYSKLTVDKSRWQQ | |
| GCGGCCCTGGGCTGCCTGGTCAAG | GNVFSCSVMHEALHNHYTQKSL | |
| GACTACTTCCCCGAACCGGTGACG | SLSPGK | |
| GTGTCGTGGAACTCAGGCGCCCTG | Without leader [SEQ ID | |
| ACCAGCGGCGTGCACACCTTCCCG | NO: 229]: | |
| GCTGTCCTACAGTCCTCAGGACTC | QVQLVQSGAEVKKPGASVKVSC | |
| TACTCCCTCAGCAGCGTGGTGACC | KASGYTFTTYWITWVRQAPGQG | |
| GTGCCCTCCAGCAGCTTGGGCACC | LEWMGDIYPGSSICNYAQKFQG | |
| CAGACCTACATCTGCAACGTGAAT | RVTMTVDTSTSTAYMELSSLRS | |
| CACAAGCCCAGCAACACCAAGGTG | EDTAVYYCAREDGYDAWFAYWG | |
| GACAAGAAAGTTGAGCCCAAATCT | QGTLVTVSSASTKGPSVFPLAP | |
| TGTGACAAAACTCACACATGCCCA | SSKSTSGGTAALGCLVKDYFPE | |
| CCGTGCCCAGCACCTGAACTCCTG | PVTVSWNSGALTSGVHTFPAVL | |
| GGGGGACCGTCAGTCTTCCTCTTC | QSSGLYSLSSVVTVPSSSLGTQ | |
| CCCCCAAAACCCAAGGACACCCTC | TYICNVNHKPSNTKVDKKVEPK | |
| ATGATCTCCCGGACCCCTGAGGTC | SCDKTHTCPPCPAPELLGGPSV | |
| ACATGCGTGGTGGTGGACGTGAGC | FLFPPKPKDTLMISRTPEVTCV | |
| CACGAAGACCCTGAGGTCAAGTTC | VVDVSHEDPEVKFNWYVDGVEV | |
| AACTGGTACGTGGACGGCGTGGAG | HNAKTKPREEQYNSTYRVVSVL | |
| GTGCATAATGCCAAGACAAAGCCG | TVLHQDWLNGKEYKCKVSNKAL | |
| CGGGAGGAGCAGTACAACAGCACG | PAPIEKTISKAKGQPREPQVYT | |
| TACCGTGTGGTCAGCGTCCTCACC | LPPSRDELTKNQVSLTCLVKGF | |
| GTCCTGCACCAGGACTGGCTGAAT | YPSDIAVEWESNGQPENNYKTT | |
| GGCAAGGAGTACAAGTGCAAGGTC | PPVLDSDGSFFLYSKLTVDKSR | |
| TCCAACAAAGCCCTCCCAGCCCCC | WQQGNVFSCSVMHEALHNHYTQ | |
| ATCGAGAAAACCATCTCCAAAGCC | KSLSLSPGK | |
| AAAGGGCAGCCCCGAGAACCACAG | | |
| GTGTACACCCTGCCCCCATCCCGG | | |
| GATGAGCTGACCAAGAACCAGGTC | | |
| AGCCTGACCTGCCTGGTCAAAGGC | | |
| TTCTATCCCAGCGACATCGCCGTG | | |
| GAGTGGGAGAGCAATGGGCAGCCG | | |
| GAGAACAACTACAAGACCACGCCT | | |
| CCCGTGCTGGACTCCGACGGCTCC | | |
| TTCTTCCTCTATATTCAAAGCTCC | | |
| GTGATGCAAGAAGGCAGCAGCAG | | |
| GGGAACGTCTTCTCATGCTCCGTG | | |

| | | |
|---|---|---|
| | | ACCTACTGGATCACCTGGA | GACTACTTCCCCGAACCG |
| | | GTGCGACAGGCTCCTGGA | GTGACGGTCGTGGAAC |
| | | CAGGGCCTGGAATGGATG | TCAGGCGCCCTGACCAGC |
| | | GGCGACATCTACCCCGGC | GGCGTGCACACCTTCCCG |
| | | TCCTCCATCTGCAACTAC | GCTGTCCTACAGTCCTCA |
| | | GCCCAGAAATTCCAGGGC | GGACTCTACTCCCTCAGC |
| | | AGAGTGACCATGACCGTG | AGCGTGGTGACCGTGCCC |
| | | GACACCTCCACCAGCACC | TCCAGCAGCTTGGGCACC |
| | | GCCTACATGGAACTGTCC | CAGACCTACATCTGCAAC |
| | | TCCCTGCGGAGCGAGGAC | GTGAATCACAAGCCCAGC |
| | | ACCGCCGTGTACTACTGC | AACACCAAGGTGGACAAG |
| | | GCTAGAGAGGACGGCTAC | AAAGTTGAGCCCAAATCT |
| | | GACGCTTGGTTTGCCTAC | TGTGACAAAACTCACACA |
| | | TGGGGCCAGGGCACCCTC | TGCCCACCGTGCCCAGCA |
| | | GTGACCGTGTCATCT | CCTGAACTCCTGGGGGGA |
| | | (Nucleotides 58 to | CCGTCAGTCTTCCTCTTC |
| | | 414 of SEQ ID NO: | CCCCCAAAACCCAAGGAC |
| | | 226) | ACCCTCATGATCTCCCGG |
| | | [SEQ ID NO: 231] | GTGGTGGTGGACGTGAGC |
| | | QVQLVQSGAEVKKPGASV | CACGAAGACCCTGAGGTC |
| | | KVSCKASGYTFTTYWITW | AAGTTCAACTGGTACGTG |
| | | VRQAPGQGLEWMGDIYPG | GACGGCGTGGAGGTGCAT |
| | | SSICNYAQKFQGRVTMTV | AATGCCAAGACAAAGCCG |
| | | DTSTSTAYMELSSLRSED | CGGGAGGAGCAGTACAAC |
| | | TAVYYCAREDGYDAWFAY | AGCACGTACCGTGTGGTC |
| | | WGQGTLVTVSS | AGCGTCCTCACCGTCCTG |
| | | [SEQ ID NO: 232] | CACCAGGACTGGCTGAAT |
| | | | GGCAAGGAGTACAAGTGC |
| | | | AAGGTCTCCAACAAAGCC |
| | | | CTCCCAGCCCCCATCGAG |
| | | | AAAACCATCTCCAAAGCC |
| | | | AAAGGGCAGCCCCGAGAA |
| | | | CCACAGGTGTACACCCTG |
| | | | CCCCCATCCCGGGATGAG |
| | | | CTGACCAAGAACCAGGTC |
| | | | AGCCTGACCTGCCTGGTC |
| | | | AAAGGCTTCTATCCCAGC |
| | | | GACATCGCCGTGGAGTGG |
| | | | GAGAGCAATGGGCAGCCG |
| | | | GAGAACAACTACAAGACC |
| | | | ACGCCTCCCGTGCTGGAC |
| | | | TCCGACGGCTCCTTCTTC |
| | | | TTATATTCAAAGCTCACC |
| | | | GTGGACAAGAGCAGGTGG |
| | | | CAGCAGGGGAACGTCTTC |
| | | | TCATGCTCCGTGATGCAT |
| | | | GAGGCTCTGCACAACCAC |
| | | | TACACGCAGAAGAGCCTC |
| | | | TCCCTGTCTCCGGG |
| | | | (Nucleotides 415 |
| | | | to 1401) |
| | | | [SEQ ID NO: 233] |

TABLE 1-continued

Without leader [SEQ ID NO: 227]:

ATGCATGAGGCTCTGCACAACCAC
TACACGCAGAAGAGCCCTCCCTG
TCTCCCGGGAAATGA

CAGGTGCAGCTGGTGCAGTCTGGC
GCCGAAGTGAAGAAACCTGGCGCC
TCCGTGAAGGTGTCCTGCAAGGCT
TCCGGCTACACCTTTACCACCTAC
TGGATCAACTGGGTGCGACAGGCT
CCTGGACAGGGCCTGGAATGGATG
GGCGACATCTACCCCGGCTCCTCC
ATCTGCAACTACGCCCAGAAATTC
CAGGGCAGAGTGACCATGACCGTG
GACACCTCCACCAGCACCGCCTAC
ATGGAACTGTCCTCCCTGCGGAGC
GAGGACACCGCCGTGTACTACTGC
GCTAGAGAGGACGGCTACCACGCT
TGGTTTGCCTACTGGGGCCAGGGC
ACCCTCGTGACCGTGTCATCTGCA
TCCACCAAGGGCCCATCGGTCTTC
CCCCTGGCACCCTCCAAGAGC
ACCTCTGGGGGCACAGCGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCCTGGGGGGACCG
TCAGTCTTCCTCTTCCCCCCAAAA
CCCAAGGACACCCTCATGATCTCC
CGGACCCCTGAGGTCACATGCGTG
GTGGTGGACGTGAGCCACGAAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC
CAGGACTGGCTGAATGGCAAGGAG
TACAAGTGCAAGGTCTCCAACAAA
GCCCTCCCAGCCCCCATCGAGAAA
ACCATCTCCAAAGCCAAAGGGCAG
CCCCGAGAACCACAGGTGTACACC
CTGCCCCCATCCCGGGATGAGCTG
ACCAAGAACCAGGTCAGCCTGACC
TGCCTGGTCAAAGGCTTCTATCCC
AGCGACATCGCCGTGGAGTGGGAG

ASTKGPSVFPLAPSSKST
SGGTAALGCLVKDYFPEP
VTVSWNSGALTSGVHTFP
AVLQSSGLYSLSSVVTVP
SSSLGTQTYICNVNHKPS
NTKVDKKVEPKSCDKTHT
CPPCPAPELLGGPSVFLF
PPKPKDTLMISRTPEVTC
VVVDVSHEDPEVKFNWYV
DGVEVHNAKTKPREEQYN
STYRVVSVLTVLHQDWLN
GKEYKCKVSNKALPAPIE
KTISKAKGQPREPQVYTL
PPSRDELTKNQVSLTCLV
KGFYPSDIAVEWESNGQP
ENNYKTTPPVLDSDGSFF
LYSKLTVDKSRWQQGNVF
SCSVMHEALHNHYTQKSL
SLSPGK
[SEQ ID NO: 234]

TABLE 1-continued

| | | | |
|---|---|---|---|
| | AGCAATGGGCAGCCGGAGAACAAC<br>TACAAGACCACGCCTCCCGTGCTG<br>GACTCCGACGGCTCTCTTCTTA<br>TATTCAAAGCTCACCGTGGACAAG<br>AGCAGGTGCAGCAGGGGAACGTC<br>TTCTCATGCTCCGTGATCATGAG<br>GCTCTGCACAACCATCACGCAG<br>AAGAGCCTCTCCCTGTCCTCCGGG<br>AAATGA | | |
| 7G6-HCzu5 | With leader [SEQ ID NO: 235]:<br>ATGGGCTGTCCTGCATCATCCTG<br>TTTCTGGTGCCACCGCCACCGC<br>GTGCACAGGTGCAGCTGGTGCAG<br>CAGTCTGGGCGCCTCCGAAGTGAAGAAA<br>CCTGGCGCCTCCGTGAAGGTGTCC<br>TGCAAGGCTTCCGGCTACACCTTT<br>ACCACTTACTGGATCACCTGGGTG<br>CGACAGGCTCCTGGACAGGGCCTG<br>GAATGGATGGGCGACATCTACCCC<br>GGCTCCTCCATCTCCAACTACAAC<br>GAGAAGTTCAAGTCCCGCGTGACC<br>ATGACCGTGACACCTCCACCAGC<br>ACCGCCTACATGGAACTGTCCTCC<br>CTGCGGAGCGAGGACACCGCCGTG<br>TACTACTGCGCTAGAGACGGCTAC<br>GACGCCTTGGTTTGCCTACTGG<br>GGCCAGGGCACCCTCGTGACCGTG<br>TCATTCGCATCCACCAAGGGCCCA<br>TCCGTCTTCCCCCTGGCACCCTCC<br>TCCAAGAGCACCTCTGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCG<br>GCTGTCCTACAGTCCTCAGGACTC<br>TACTCCCTCAGCAGCGTGGTGACC<br>GTGCCCTCCAGCAGCTTGGGCACC<br>CAGACCTACATCTGCAACGTGAAT<br>CACAAGCCCAGCAACACCAAGGTG<br>GACAAGAAAGTTGAGCCCAAATCT<br>TGTGACAAAACTCACACATGCCCA<br>CCGTGCCCAGCACCTGAACTCCTG<br>GGGGGACCGTCAGTCTTCCTCTTC<br>CCCCCAAAACCCAAGGACACCCTC<br>ATGATCTCCCGGACCCCTGAGGTC<br>ACATGCGTGGTGGTGGACGTGAGC<br>CACGAAGACCCTGAGGTCAAGTTC<br>AACTGGTACGTGGACGGCGTGGAG<br>GTGCATAATGCCAAGACAAAGCCG<br>CGGGAGGAGCAGTACAACAGCACG<br>TACCGTGTGGTCAGCGTCCTCACC | With leader [SEQ ID NO: 237]:<br>MGWSCIILFLVATATGVHSQVQ<br>LVQSGAEVKKPGASVKVSCKAS<br>GYTFTTYWITWRQAPGQGLEWM<br>GDIYPGSSISNYNEKFKSRVT<br>MTVDTSTSTAYMELSSLRSEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br>Without leader [SEQ ID NO: 238]:<br>QVQLVQSGAEVKKPGASVKVSC<br>KASGYTFTTYWITWRQAPGQG<br>LEWMGDIYPGSSISNYNEKFKS<br>RVTMTVDTSTSTAYMELSSLRS<br>EDTAVYYCAREDGYDAWFAYWG<br>QGTLVTVSSASTKGPSVFPLAP<br>SSKSTSGGTAALGCLVKDYFPE<br>PVTVSWNSGALTSGVHTFPAVL<br>QSSGLYSLSSVVTVPSSSLGTQ<br>TYICNVNHKPSNTKVDKKVEPK<br>SCDKTHTCPPCPAPELLGGPSV<br>FLFPPKPKDTLMISRTPEVTCV<br>VVDVSHEDPEVKFNWYVDGVEV<br>HNAKTKPREEQYNSTYRVVSVL<br>TVLHQDWLNGKEYKCKVSNKAL<br>PAPIEKTISKAKGQPREPQVYT<br>LPPSRDELTKNQVSLTCLVKGF | CAGGTGCAGCTGGTGCAG<br>TCTGGCGCCGAAGTGAAG<br>AAACCTGGCGCCTCCGTG<br>AAGGTGTCTGCAAGGCT<br>TCCGGCTACACCTTTACC<br>ACTTACTGGATCACCTGG<br>GTGCGACAGGCTCCTGGA<br>CAGGGCCTGGAATGATG<br>GGCGACATCTACCCGGC<br>TCCTCCATCTCCAACTAC<br>AACGAGAAGTTCAAGTCC<br>CGCGTGACCATGACCGTG<br>GACACCTCCACCAGCACC<br>GCCTACATGGAACTGTCC<br>TCCCTGCGGAGCGAGGAC<br>ACCGCCGTGTACTACTGC<br>GCTAGAGACGGCTAC<br>GACGCTTGGTTTGCCTAC<br>TGGGGCCAGGGCACCCTC<br>GTGACCGTGTCATCT<br>(Nucleotides 58 to<br>414 of SEQ ID NO:<br>235)<br>[SEQ ID NO: 240]<br>QVQLVQSGAEVKKPGASV<br>KVSCKASGYTFTTYWITW<br>VRQAPGQGLEWMGDIYPG<br>SSISNYNEKFKSRVTMTV<br>DTSTSTAYMELSSLRSED<br>TAVYYCAREDGYDAWFAY<br>WGQGTLVTVSS<br>[SEQ ID NO: 241] | GCATCACCAAGGGCCCA<br>TCGGTCTTCCCCCTGGCA<br>CCCTCCTCCAAGAGCACC<br>TCTGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGGA<br>CCGTCAGTCTTCCTCTTC<br>CCCCCAAAACCCAAGGAC<br>ACCCTCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT<br>AATGCCAAGACAAAGCCG<br>CGGGAGGAGCAGTACAAC<br>AGCACGTACCGTGTGGTC<br>AGCGTCCTCACCGTGTG<br>CACCAGGACTGGCTGAAT<br>GGCAAGGAGTACAAGTGC<br>AAGGTCTCCAACAAAGCC<br>CTCCCAGCCCCATCGAG<br>AAAACCATCTCCAAAGCC<br>AAAGGGCAGCCCCGAGAA<br>CCACAGGTGTACACCCTG<br>CCCCCATCCGGGATGAG<br>CTGACCAAGAACCAGGTC<br>AGCCTGACCTGCCTGGTC<br>AAAGGCTTCTATCCCAGC |

TABLE 1-continued

| | | |
|---|---|---|
| GTCCTGCACCAGGACTGCTGAAT<br>GGGCAAGGAGTACAGTGCAAGGTC<br>TCCAACAAAGCCCCTCCAGCCCCC<br>ATCGAGAAACCATCTCCAAAGCC<br>AAAGGGCAGCCCCGAGAACCACAG<br>GTGTACACCCTGCCCCCATCCCGG<br>GATGAGCTGACCAAGAACCAGGTC<br>AGCCTGACCTGCCTGGTCAAAGGC<br>TTCTATCCCAGCGACATCGCCGTG<br>GAGTGGGAGAGCAATGGGCAGCCG<br>GAGAACAACTACAAGACCACGCCT<br>CCCGTGCTGGACTCCGACGGCTCC<br>TTCTTCTTATATTCAAAGCTCACC<br>GTGGACAAGAGCAGGTGGCAGCAG<br>GGGAACGTCTTCTCATGCTCCGTG<br>ATGCATGAGGCTCTGCACAACCAC<br>TACACGCAGAAGAGCCTCTCCCTG<br>TCTCCGGGAAATGA<br>Without leader [SEQ ID<br>NO: 236]:<br>CAGGTGCAGCTGGTGCAGTCTGGC<br>GCCGAAGTGAAGAAACCTGGCGCC<br>TCCGTGAAGGTGTCCTGCAAGGCT<br>TCCGGCTACACCTTTACCACCTAC<br>TGGATCAACTGGGTGCGACAGGCT<br>CCTGGACAGGGCCTGGAATGGATG<br>GGCCACATTCACCCGGCTCCTCC<br>ATCTCCAACTACCACGAGAGTTC<br>AAGTCCCGCGTGACCATGACCGTG<br>GACACCTCCACCAGCACCGCCTAC<br>ATGGAACTGCTCCCCTGCGAGC<br>GAGACACCGCCGTGTACTACTGC<br>GCTAGAGAGGACGCTACGACGCT<br>TGGTTTGCCTACTGGGGCCAGGGC<br>ACCCTCGTGACCGTGTCATCTGCA<br>TCCACCAAGGGCCCATCGGTCTTC<br>CCCCTGGCACCCCCTCTCCAAGAGC<br>ACCTCTGGGGGCACAGCGGCCTG<br>GGCTGCCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTA<br>CAGTCCTCAGGACTCTACTCCCTC<br>AGCAGCGTGGTGACCGTGCCCTCC<br>AGCAGCTTGGGCACCCAGACCTAC<br>ATCTGCAACGTGAATCACAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCCTGGGGGACCG<br>TCAGTCTTCCTCTTCCCCCCCAAAA<br>CCCAAGGACACCCTCATGATCTCC<br>CGGACCCCTGAGGTCACATGCGTG | YPSDIAVEWESNGQPENNYKTT<br>PPVLDSDGSFFLYSKLTVDKSR<br>WQQGNVFSCSVMHEALHNHYTQ<br>KSLSLSPGK | GACATCGCCGTGGAGTGG<br>GAGAGCAATGGGCAGCCG<br>GAGAACAACTACAAGACC<br>ACGCCTCCCGTGCTGGAC<br>TCCGACGGCTCCTTCTTC<br>TTATATTCAAAGCTCACC<br>GTGGACAAGAGCAGGTGG<br>CAGCAGGGGAACGTCTTC<br>TCATGCTCCGTGATGCAT<br>GAGGCTCTGCACAACCAC<br>TACACGCAGAAGAGCCTC<br>TCCCTGTCTCCGGG<br>(Nucleotides 415<br>to 1401 of SEQ ID<br>NO: 235)<br>[SEQ ID NO: 242]<br>ASTKGPSVFPLAPSSKST<br>SGGTAALGCLVKDYFPEP<br>VTVSWNSGALTSGVHTFP<br>AVLQSSGLYSLSSVVTVP<br>SSSLGTQTYICNVNHKPS<br>NTKVDKKVEPKSCDKTHT<br>CPPCPAPELLGGPSVFLF<br>PPKPKDTLMISRTPEVTC<br>VVVDVSHEDPEVKFNWYV<br>DGVEVHNAKTKPREEQYN<br>STYRVVSVLTVLHQDWLN<br>GKEYKCKVSNKALPAPIE<br>KTISKAKGQPREPQVYTL<br>PPSRDELTKNQVSLTCLV<br>KGFYPSDIAVEWESNGQP<br>ENNYKTTPPVLDSDGSFF<br>LYSKLTVDKSRWQQGNVF<br>SCSVMHEALHNHYTQKSL<br>SLSPGK<br>[SEQ ID NO: 243] |

TABLE 1-continued

| | | | |
|---|---|---|---|
| | GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCCTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCCGGG<br>AAATGA | | |
| 7G6-<br>HCzu6 | With leader [SEQ ID NO: 244]:<br><u>ATGGGCTGGTCCTGCATCATCTG<br>TTTCTGGTGGCCACCGCCACCGGC</u><br>GTGCACAGCCAGGTGCAGCTGGTG<br>CAGTCTGGCGCCGAAGTGAAGAAA<br>CCTGGCGCCTCCGTGAAGGTGTCC<br>TGCAAGGCTTCCGGCTACACCTTT<br>ACCACCTACTGGATCACCTGGGTG<br>CGACAGGCTCCTGGACAGGGCCTG<br>GAATGGATGGGCGACATCTACCCC<br>GGCTCCTCCATCTCCAACTACAAC<br>GAGAAGTTCAAGTCCCGCGTGACC<br>ATGACCGTGGACACCTCCACCAGC<br>ACCGTGTACATGGAACTGTCCTCC<br>CTGCGGAGCGAGGACACCGCCGTG<br>TACTACTGCGCTAGAGAGGACGGC<br>TACGACGCTTGGTTTGCCTACTGG<br>GGCCAGGGCACCCTCGTGACCGTG<br>TCATCTGCAGCCTCCACCAAGGGC<br>CCGTCTTCCCCCTGGCACCCTCC<br>TCCAAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC | With leader [SEQ ID NO: 246]:<br><u>MGWSCIILFLVATATGVHSQVQ</u><br>LVQSGAEVKKPGASVKVSCKAS<br>GYTFTTYWITWVRQAPGQGLEW<br>MGDIYPGSSISNYNEKFKSRVT<br>MTVDTSTSTVYMELSSLRSEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br>Without leader [SEQ ID NO: 247]:<br>QVQLVQSGAEVKKPGASVKVSC<br>KASGYTFTTYWITWVRQAPGQG | ATGGGCTG<br>GTCCTGCA<br>TCATCCTG<br>TTTCTGGT<br>GGCCACCG<br>CCACCGGC<br>GTGCACAG<br>C<br>(Nucleotides 1 to 57 of SEQ ID NO: 244)<br>[SEQ ID NO: 248] | CAGGTGCAGCTGGTGCAG<br>TCTGGCGCCGAAGTGAAG<br>AAACCTGGCGCCTCCGTG<br>AAGGTGTCCTGCAAGGCT<br>TCCGGCTACACCTTTACC<br>ACCTACTGGATCACCTGG<br>GTGCGACAGGCTCCTGGA<br>CAGGGCCTGGAATGGATG<br>GGCGACATCTACCCCGGC<br>TCCTCCATCTCCAACTAC<br>AACGAGAAGTTCAAGTCC<br>CGCGTGACCATGACCGTG<br>GACACCTCCACCAGCACC<br>GTGTACATGGAACTGTCC<br>TCCCTGCGGAGCGAGGAG<br>ACCGCCGTGTACTACTGC<br>GCTAGAGAGGACGGCTAC<br>GACGCTTGGTTTGCCTAC<br>TGGGGCCAGGGCACCCTC<br>GTGACCGTGTCATCT<br>(Nucleotides 58 to 414 of SEQ ID NO: 244)<br>[SEQ ID NO: 249]<br>QVQLVQSGAEVKKPGASV<br>KVSCKASGYTFTTYWITW<br>VRQAPGQGLEWMGDIYPG<br>SSISNYNEKFKSRVTMTV | GCATCCACCAAGGGCCCA<br>TCGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAGTTGAGCCCCAAATCT<br>TGTGACAAAACTCACACA<br>TGCCCACCGTGCCCAGCA<br>CCTGAACTCCTGGGGGA<br>CCGTCAGTCTTCCTCTTC<br>CCCCCAAAACCCAAGGAC<br>ACCCTCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT |

TABLE 1-continued

| | | |
|---|---|---|
| GTGCCCTCCAGCAGCTTGGGCACC | LEWMGDIYPGSSISNYNEKFKS | DTSTSTVYMELSSLRSED |
| CAGACCTACATCTGCAACGTGAAT | RVTMTVDTSTSTVYMELSSLRS | TAVYYCAREDGYDAWFAY |
| CACAAGCCCAGCAACACCAAGGTG | EDTAVYYCAREDGYDAWFAYWG | WGQGTLVTVSS |
| GACAAGAAAGTTGAGCCCAAATCT | QGTLVTVSSASTKGPSVFPLAP | [SEQ ID NO: 250] |
| TGTGACAAAACTCACACATGCCCA | SSKSTSGGTAALGCLVKDYFPE | |
| CCCTGCCCAGCACCTGAACTCCTG | PVTVSWNSGALTSGVHTFPAVL | |
| GGGGACCCTCAGTCTTCCTCTTC | QSSGLYSLSSVVTVPSSSLGTQ | |
| CCCCAAAACCAAGGACACCCTC | TYICNVNHKPSNTKVDKKVEPK | |
| ATGATCTCCCGGACCCCTGAGGTC | SCDKTHTCPPCPAPELLGGPSV | |
| ACATGCGTGGTGGACGTGAGC | FLFPPKPKDTLMISRTPEVTCV | |
| CACGAAGCCTGAGGTCAAGTTC | VVDVSHEDPEVKFNWYVDGVEV | |
| AACTGGTACGTGGACGGCGTGGAG | HNAKTKPREEQYNSTYRVVSVL | |
| GTGCATAATGCCAAGACAAAGCCG | TVLHQDWLNGKEYKCKVSNKAL | |
| CGGGAGGAGCAGTACAACAGCACG | PAPIEKTISKAKGQPREPQVYT | |
| TACCGTGTGTCAGCGTCCTCACC | LPPSRDELTKNQVSLTCLVKGF | |
| GTCCTGCACCAGGACTGGCTGAAT | YPSDIAVEWESNGQPENNYKTT | |
| GGCAAGGAGTACAAGTGCAAGGTC | PPVLDSDGSFFLYSKLTVDKSR | |
| TCCAACAAAGCCATCTCCAAGCCC | WQQGNVFSCSVMHEALHNHYTQ | |
| ATCGAGAAAACCATCTCCAAAGCC | KSLSLSPGK | |
| AAAGGGCAGCCCCGAGAACCACAG | | |
| GTGTACACCCTGCCCCCATCCGG | | |
| GATGAGCTGACCAAGAACCAGGTC | | |
| AGCCTGACCTGCCTGGTCAAAGGC | | |
| TTCTATCCCAGCGACATCGCCGTG | | |
| GAGTGGGAGAGCAATGGGCAGCCG | | |
| GAGAACAACTACAAGACCACGCCT | | |
| CCCGTGCTGGACTCCGACGGCTCC | | |
| TTCTTCTTATATTCAAAGCTCACC | | |
| GTGGACAAGAGCAGGTGGCAGCAG | | |
| GGGAACGTCTTCTCATGCTCCGTG | | |
| ATGCATGAGGCTCTGCACAACCAC | | |
| TACACGCAGAAGAGCCTCTCCCTG | | |
| TCTCCGGGTAAATGA | | |
| Without leader [SEQ ID | | |
| NO: 245]: | | |
| CAGTGCAGCTGGTGCAGTCTGGC | | |
| GCCGAAGTGAAGAAACCTGGCGCC | | |
| TCCGTGAAGGTGTCCTGCAAGGCT | | |
| TCCGGCTACACCTTTACCACCTAC | | |
| TGGATCACCTGGGTGCGACAGGCT | | |
| CCTGGACAGGGCCTGGAATGGATG | | |
| GGCGACATCTACCCGGCTCCTCC | | |
| ATCTCCAACTACAACGAGAAGTTC | | |
| AAGTCCGTGACCATGACCGTG | | |
| GACACCTCCACCAGCACCGTGTAC | | |
| ATGGAACTGTCTCCCTGCGGAGC | | |
| GAGACACCGCCGTGTACTACTGC | | |
| GCTAGAGACGGCTACGACGCT | | |
| TGGTTTGCCTACTGGGGCCAGGGC | | |
| ACCCTCGTGACCGTCATCGGTTC | | |
| TCCCACCAAGGGCCCATCCGGTCTTC | | |
| CCCCTGGCACCCTCCTCCAAGAGC | | |
| ACCTCTGGGGGCACAGCGCCCTG | | |

(Nucleotides 415
to 1401)
[SEQ ID NO: 251]
ASTKGPSVFPLAPSSKST
SGGTAALGCLVKDYFPEP
VTVSWNSGALTSGVHTFP
AVLQSSGLYSLSSVVTVP
SSSLGTQTYICNVNHKPS
NTKVDKKVEPKSCDKTHT
CPPCPAPELLGGPSVFLF
PPKPKDTLMISRTPEVTC
VVVDVSHEDPEVKFNWYV
DGVEHNAKTKPREEQYN
STYRVVSVLTVLHQDWLN
GKEYKCKVSNKALPAPIE
KTISKAKGQPREPQVYTL
PPSRDELTKNQVSLTCLV
KGFYPSDIAVEWESNGQP
ENNYKTTPPVLDSDGSFF
LYSKLTVDKSRWQQGNVF
SCSVMHEALHNHYTQKSL
SLSPGK
[SEQ ID NO: 252]

TABLE 1-continued

| | | | |
|---|---|---|---|
| | GGCTGCCTGGTCAAGGACTACTTC | | |
| | CCCGAACCGGTGACGGTGTCGTGG | | |
| | AACTCAGGCGCCCTGACCAGCGGC | | |
| | GTGCACACCTTCCCGGCTGTCCTA | | |
| | CAGTCCTCAGGACTCTACTCCCTC | | |
| | AGCAGCGTGGTGACCGTGCCCTCC | | |
| | AGCAGCTTGGGCACCCAGACCTAC | | |
| | ATCTGCAACGTGAATCACAAGCCC | | |
| | AGCAACACCAAGGTGGACAAGAAA | | |
| | GTTGAGCCCAAATCTTGTGACAAA | | |
| | ACTCACACATGCCCACCGTGCCCA | | |
| | GCACCTGAACTCCTGGGGGACCG | | |
| | TCAGTCTTCCTCTTCCCCCCAAAA | | |
| | CCCAAGGACACCCTCATGATCTCC | | |
| | CGGACCCCTGAGGTCACATGCGTG | | |
| | GTGGTGGACGTGAGCCACGAAGAC | | |
| | CCTGAGGTCAAGTTCAACTGGTAC | | |
| | GTG | | |
| | GACGGCGTGGAGGTGCATAATGCC | | |
| | AAGACAAAGCCGCGGGAGGAGCAG | | |
| | TACAACAGCACGTACCGTGTGGTC | | |
| | AGCGTCCTCACCGTCCTGCACCAG | | |
| | GACTGGCTGAATGGCAAGGAGTAC | | |
| | AAGTGCAAGGTCTCCAACAAAGCC | | |
| | CTCCCAGCCCCCATCGAGAAAACC | | |
| | ATCTCCAAAGCCAAAGGGCAGCCC | | |
| | CGAGAACCACAGGTGTACACCCTG | | |
| | CCCCCATCCCGGGATGAGCTGACC | | |
| | AAGAACCAGGTCAGCCTGACCTGC | | |
| | CTGGTCAAAGGCTTCTATCCCAGC | | |
| | GACATCGCCGTGGAGTGGGAGAGC | | |
| | AATGGGCAGCCGGAGAACAACTAC | | |
| | AAGACCACGCCTCCCGTGCTGGAC | | |
| | TCCGACGGCTCCTTCTTCCTCTATAT | | |
| | TCAAAGTTCACCGTGGACAAGAGC | | |
| | AGGTGGCAGCAGGGGAACGTCTTC | | |
| | TCATGCTCCGTGATGCATGAGGCT | | |
| | CTGCACAACCACTACACGCAGAAG | | |
| | AGCCTCTCCCTGTCTCCGGGAAA | | |
| | TGA | | |
| 7G6-HCzu7 | With leader [SEQ ID NO: 253]: ATGGGCTGGTCCTGCATCATCCTG TTTCTGGTGGCCACCGCCACCGGC GTGCACAGCCAGGTGCAGCTGGTG CAGTCTGGCGCCGAAGTGAAGAAA CCTGGCGCTTCCGTGAAGGTGTCC TGCAAGGCTTCCGGCTACACCTTT ACCACCTACTGGATCACCTGGGTG CGACAGGCTCCTGGACAGGGCCTG GAATGGATGGGCGACATCTACCCC GGCTCCTCCATCTCCAACTACGCC | With leader [SEQ ID NO: 255]: MGWSCIILFLVATATGVHSQVQ LVQSGAEVKKPGASVKVSCKAS GYTFTTYWITWVRQAPGQGLEW MGDIYPGSSISNYAQKFQGRVT MTVDTSTSTVYMELSSLRSEDT AVYYCAREDGYDAMFAYWGQGT LVTVSSASTKGPSVFPLAPSSK STSGGTAALGCLVKDYFPEPVT VSWNSGALTSGVHTFPAVLQSS GLYSLSSVVTVPSSSLGTQTYI | CAGGTGCAGCTGGTGCAG TCTGGCGCCGAAGTGAAG AAACCTGGCGCCTCCGTG AAGGTGTCCTGCAAGGCT TCCGGCTACACCTTTACC ACCTACTGGATCACCTGG GTGCGACAGGCTCCTGGA CAGGGCCTGGAATGGATG GGCGACATCTACCCCGGC TCCTCCATCTCCAACTAC GCCCAGAAGTTCCAGGGC CGGGTGACCATGACCGTG | GCATCCACCAAGGGCCCA TCGGTCTTCCCCCTGGCA CCCTCCTCCAAGAGCACC TCTGGGGCTGCCAGCGCC CTGGGCTGCCTGGTCAAG GACTACTTCCCCGAACCG GTGACGGTGTCGTGGAAC TCAGGCGCCCTGACCAGC GGCGTGCACACCTTCCCG GCTGTCCTACAGTCCTCA GGACTCTACTCCCTCAGC AGCGTGGTGACCGTGACC |
| | | (Nucleotides 1 to 57 of SEQ ID | | |

TABLE 1-continued

| | | |
|---|---|---|
| CAGAAGTTCCAGGGGACCCGTGACC | CNVNHKPSNTKVDKKVEPKSCD | NO: 253) | GACACCTCCACCAGCACC | TCCAGCAGTTGGGCACC |
| ATGACCGTGGAACCTCCACCAGC | KTHTCPPCPAPELLGGPSVFLF | [SEQ ID | GTGTACATGGAACTGTCC | CAGACCTACATCTGCAAC |
| ACCCTGTACATGGAGAGCACCTGCCTC | PPKPKDTLMISRTPEVTCVVVD | NO: 257] | TCCCTGCGGAGCGAGGAC | GTGAATCACAAGCCCAGC |
| CTGCGGAGCGAGGACACCGCCGTG | VSHEDPEVKFNWYVDGVEVHNA | | ACCGCCGTGTACTACTGC | AACACCAAGGTGACAAG |
| TACTACTGCGCTAGAGAGGACGGC | KTKPREEQYNSTYRVVSVLTVL | | GCTAGAGAGGACGGCTAC | AAAGTTGAGCCAAATCT |
| TACGACGCTTGGTTTGCCTACTGG | HQDWLNGKEYKCKVSNKALPAP | | GACGCTTGGTTTGCCTAC | TGTGACAAAACTCACACA |
| GGCCAGGGCACCCTCGTGACCGTG | IEKTISKAKGQPREPQVTLPP | | TGGGGCCAGGGCACCCTC | TGCCCACCGTGCCCAGCA |
| TCATCTGCATCCACCAAGGGCCCA | SRDELTKNQVSLTCLVKGFYPS | | GTGACCGTGTCATCT | CCTGAACTCCTGGGGGGA |
| TCGGTTCTTCCCCCTGGCACCCTC | DIAVEWESNGQPENNYKTTPPV | | Nucleotides 58 to | CCGTCAGTCTTCCTCTTC |
| TCCAAGAGCACCTCTGGGGGCACA | LDSDGSFFLYSKLTVDKSRWQQ | | 414 of SEQ ID NO: | CCCCAAAACCCAAGGAC |
| GCGGCCCTGGGCTGCCTGGTCAAG | GNVFSCSVMHEALHNHYTQKSL | | 253) | ACCCTCATGATCTCCGG |
| GACTACTTCCCCGAACCGGTGACG | SLSPGK | | | ACCCCTGAGGTCACATGC |
| GTGTCGTGGAACTCAGGCGCCCTG | Without leader [SEQ ID | | [SEQ ID NO: 258] | CACGAAGACCCTGAGGTC |
| ACCAGCGGCGTGCACACCTTCCCG | NO: 256]: | | QVQLVQSGAEVKKPGASV | GTGGTGGTGACGTGAGC |
| GCTGTCCTACAGGTCCTCAGGACTC | QVQLVQSGAEVKKPGASVKVSC | | KVSCKASGYTFTTYWITW | AAGTTCAACTGTACGTG |
| TACTCCCTCAGCAGCGTGTGACC | KASGYTFTTYWIITWVRQAPGQG | | VRQAPGQGLEWMGDIYPG | GACGCGTGGAGGTGCAT |
| GTGCCCTCCAGCAGCTTGGGCACC | LEWMGDIYPGSSISNYAQKFQG | | SSISNYAQKFQGRVTMTV | AATGCCAAGACAAAGCCG |
| CAGACCTACATCTGCAACGTGAAT | RVTMTVDTSTSTVYMELSSLRS | | DTSTSTVYMELSSLRSED | CGGGAGGAGCAGTACAAC |
| CACAACCACAAGCCCAGCAACACC | EDTAVYYCAREDGYDAWFAYWG | | TAVYYCAREDGYDAWFAY | AGCACGTACCGTGGTGTC |
| AAGGTGGACAAGAAAGTTGAGCCC | QGTLVTVSSASTKGPSVFPLAP | | WGQGTLVTVSS | AGCGTCCTCACCGTCCTG |
| AAATCT | SSKSTSGTAALGCLVKDYFPE | | | CACCAGGACTGGCTGAAT |
| TGTGACAAAACTCACACATGCCCA | PVTVSWNSGALTSGVHTFPAVL | | [SEQ ID NO: 259] | GGCAAGGAGTACAAGTGC |
| CCGTGCCCAGCACCTGAACTCCTG | QSSGLYSLSSVVTVPSSSLGTQ | | | AAGGTCTCCAACAAAGCC |
| GGGGGACCGTCAGTCTTCCTCTTC | TYICNVNHKPSNTKVDKKVEPK | | | CTCCCAGCCCCCATCGAG |
| CCCCCAAAACCCAAGGACACCCTC | SCDKTHTCPPCPAPELLGGPSV | | | AAAACCATCTCCAAAGCC |
| ATGATCTCCCGGACCCCTGAGGTC | FLFPPKPKDTLMISRTPEVTCV | | | AAAGGGCAGCCCCGAGAA |
| ACATGCGTGGTGTGGACGTGAGC | VVDVSHEDPEVKFNWYVDGVEV | | | CCACAGGTGTACACCCTG |
| CACGAAGACCCTGAGGTCAAGTTC | HNAKTKPREEQYNSTYRVVSVL | | | CCCCCATCCCGGGATGAG |
| AACTGGTACGTGGACGGCGTGGAG | TVLHQDWLNGKEYKCKVSNKAL | | | CTGACCAAGAACCAGGTC |
| GTGCATAATGCCAAGACAAAGCCG | PAPIEKTISKAKGQPREPQVYT | | | AGCCTGACCTGCCTGGTC |
| CGGGAGGAGCAGTACAACAGCACG | LPPSRDELTKNQVSLTCLVKGF | | | AAAGGCTTCTATCCCAGC |
| TACCGTGTGGTCAGCGTCCTCACC | YPSDIAVEWESNGQPENNYKTT | | | GACATCGCCGTGGAGTGG |
| GTCCTGCACCAGGACTGGCTGAAT | PPVLDSDGSFFLYSKLITVDKSR | | | GAGAGCAATGGGCAGCCG |
| GGCAAGGAGTACAAGTGCAAGGTC | WQQGNVFSCSVMHEALHNHYTQ | | | GAGAACAACTACAAGACC |
| TCCAACAAAGCCCTCCCAGCCCCC | KSLSLSPGK | | | ACGCCTCCCGTGCTGGAC |
| ATCGAGAAAACCATCTCCAAAGCC | | | | TCCGACGGCTCCTTCTTC |
| AAAGGGCAGCCCCGAGAACCACAG | | | | TTATATTCAAAGCTCACC |
| GTGTACACCCTGCCCCCATCCCGG | | | | GTGGACAAGAGCAGGTGG |
| GATGAGCTGACCAAGAACCAGGTC | | | | CAGCAGGGGAACGTCTTC |
| AGCCTGACCTGCCTGGTCAAAGGC | | | | TCATGCTCCGTGATGCAT |
| TTCTATCCCAGCGACATCGCCGTG | | | | GAGGCTCTGCACAACCAC |
| GAGTGGGAGAGCAATGGGCAGCCG | | | | TACACGCAGAAGAGCCTC |
| GAGAACAACTACAAGACCACGCCT | | | | TCCCTGTCTCCGGG |
| CCCGTGCTGGACTCCGACGGCTCC | | | | |
| TTCTTCCTCTATATTCAAAGCTCACC | | | | (Nucleotides 415 |
| GTGGACAAGAGTCAGGTGGCAGCAG | | | | to 1401 of SEQ ID |
| GGGAACGTCTTCTCATGCTCCGTG | | | | NO: 253) |
| ATGCATGAGGCTCTGCACAACCAC | | | | |
| TACACGCAGAAGAGCCTCTCCCTG | | | | [SEQ ID NO: 260] |
| TCTCCGGGTAAATGA | | | | ASTKGPSVFPLAPSSKST |
| Without leader [SEQ ID | | | | SGGTAALGCLVKDYFPEP |
| NO: 254]: | | | | VTVSWNSGALTSGVHTFP |
| CAGGTGCAGCTGGTGCAGTCTGGC | | | | AVLQSSGLYSLSSVVTVP |
| GCCGAAGTGAAGAAACCTGGCGCC | | | | SSSLGTQTYICNVNHKPS |
| | | | | NTKVDKKVEPKSCDKTHT |

TABLE 1-continued

```
TCCCTGAAGGTGTCCTGCAAGGCT        CPPCPAPELLGGPSVFLF
TCCGGCTACACCTTACCACCTAC         PPKPKDTLMISRTPEVTC
TGGATCACCTGGGTGCGACAGGCT        VVVDVSHEDPEVKFNWYV
CCTGGACAGGGCTGAATGGATG          DGVEVHNAKTKPREEQYN
GGCGACATCTACCCCGGCTCCTC         STYRVVSVLTVLHQDWLN
ATCTCCAACTACCCCAGAAGTTC         GKEYKCKVSNKALPAPIE
CAGGGCCGGTGACCATGACCGTG         KTISKAKGQPREPQVYTL
GACACCTCCACCAGCACCGTGTAC        PPSRDELTKNQVSLTCLV
ATGGAACTGTCCTCCCTGCGAGC         KGFYPSDIAVEWESNGQP
GAGGACACCGCCGTGTACTACTGC        ENNYKTTPPVLDSDGSFF
GCTAGAGAGACCGTCTACGACGCT        LYSKLTVDKSRWQQGNVF
TGGTTTGCCTACTGGGGCCAGGGC        SCSVMHEALHNHYTQKSL
ACCCTGGTGACCGTGTCATCTGCA        SLSPGK
TCCACCAAGGGCCCATCGGTCTTC        [SEQ ID NO: 261]
CCCCTGGCACCCTCCTCCAAGAGC
ACCTCTGGGGGCACAGCGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCCTGGGGGGACCG
TCAGTCTTCCTCTTCCCCCCAAAA
CCCAAGGACACCCTCATGATCTCC
CGGACCCCTGAGGTCACATGCGTG
GTGGTGGACGTGAGCCACGAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC
CAGGACTGGCTGAATGGCAAGGAG
TACAAGTGCAAGGTCTCCAACAAA
GCCCTCCCAGCCCCCATCGAGAAA
ACCATCTCCAAAGCCAAAGGGCAG
CCCCGAGAACCACAGGTGTACACC
CTGCCCCCATCCCGGGATGAGCTG
ACCAAGAACCAGGTCAGCCTGACC
TGCCTGGTCAAAGGCTTCTATCCC
AGCGACATCGCCGTGGAGTGGGAG
AGCAATGGGCAGCCGGAGAACAAC
TACAAGACCACGCCTCCCGTGCTG
GACTCCGACGGCTCCTTCTTCTTA
TATTCAAAGCTCACCGTGGACAAG
AGCAGGTGGCAGCAGGGGAACGTC
TTCTCATGCTCCGTGATGCATGAG
GCTCTGCACAACCACTACACGCAG
```

TABLE 1-continued

| | | | |
|---|---|---|---|
| | AAGAGCCTCTCCCCTGTCTCCCGGG<br>AAATGA | | |
| 7G6-<br>HCzu8 | With leader [SEQ ID NO:<br>262]:<br>ATGGGCTGCTCCTGCCACGCCACCCTG<br>TTTCTGGTGGCCACCGGCGTGCACAGCCAGGTG<br>GTGCACAGCCAGCCAGGTGCAGCTGGTG<br>CAGTCTGGCGCCGAAGTGAAGAAA<br>CCTGGCGCCTCCGTGAAGGTGTCC<br>TGCAAGGCTTCCGGCTACACCTTT<br>ACCACTACTGGATCACCTGGGTG<br>CGACAGGCTCCTGGACAGGGCCTG<br>GAATGGATGGGCGACATCTACCCC<br>GGCTCCATCTCCAACTACGCCCAG<br>CAGAAGTTCCAGGGCCGCGTGACC<br>ATGACCCGGGACACCTCCACCAGC<br>ACCGTGTACATGGAACTGTCCTCC<br>CTGCGGAGCGAAGACACCGCCGTG<br>TACTACTGCGCTAGAGAGGACGGC<br>TACGACGCTTGTGTTTGCCTACTGG<br>GGCCAGGGCACCCTCGTGACCGTG<br>TCATCTGCATCCACCAAGGGCCCA<br>TCCGTCTTCCCCCTGGCACCTCC<br>TCCAAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC<br>GTGCCCTCCAGCAGCTTGGGCACC<br>CAGACCTACATCTGCAACGTGAAT<br>CACAAGCCCAGCAACACCAAGGTG<br>GACAAGAAAGTTGAGCCCAAATCT<br>TGTGACAAAACTCACACATGCCCA<br>CCGTGCCCAGCACCTGAACTCCTG<br>GGGGGACCGTCAGTCTTCCTCTTC<br>CCCCCAAAACCCAAGGACACCCTC<br>ATGATCTCCCGGACCCCTGAGGTC<br>ACATGCGTGGTGGTGGACGTGAGC<br>CACGAAGACCCTGAGGTCAAGTTC<br>AACTGGTACGTGGACGGCGTGGAG<br>GTGCATAATGCCAAGACAAAGCCG<br>CGGGAGGAGCAGTACAACAGCACG<br>TACCGTGTGGTCAGCGTCCTCACC<br>GTCCTGCACCAGGACTGGCTGAAT<br>GGCAAGGAGTACAAGTGCAAGGTC<br>TCCAACAAAGCCCTCCCAGCCCCC<br>ATCGAGAAAACCATCTCCAAAGCC<br>AAAGGGCAGCCCCGAGAACCACAG<br>GTGTACACCCTGCCCCCATCCCGG<br>GATGAGCTGACCAAGAACCAGGTC | CAGGTGCAGCTGGTGCAG<br>TCTGGCGCCGAAGTGAAG<br>AAACCTGGCGCCTCCGTG<br>AAGGTGTCCTGCAAGGCT<br>TCCGGCTACACCTTTACC<br>ACTACTGGATCACCTGG<br>GTGCGACAGGCTCCTGGA<br>CAGGGCCTGGAATGGATG<br>GGCGACATCTACCCCGGC<br>TCCTCCATCTCCAACTAC<br>GCCCAGAAGTTCCAGGGC<br>CGCGTGACCATGACCCGG<br>GACACCTCCACCAGCACC<br>GTGTACATGGAACTGTCC<br>TCCCTGCGGAGCGAGGAC<br>ACCGCCGTGTACTACTGC<br>GCTAGAGAGGACGGCTAC<br>GACGCTTGTGTTTGCCTAC<br>TGGGGCCAGGGCACCCTC<br>GTGACCGTGTCATCT<br>(Nucleotides 58 to<br>414 of SEQ ID NO:<br>262)<br>[SEQ ID NO: 267]<br>QVQLVQSGAEVKKPGASV<br>KVSCKASGYTFTTYWITW<br>VRQAPGQLEWMGDIYPG<br>SSISNYAQKFQGRVTMTR<br>DTSTSTVYMELSSLRSED<br>TAVYYCAREDGYDAWFAY<br>WGQGTLVTVSS<br>[SEQ ID NO: 268] | GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGGA<br>CCGTCAGTCTTCCTCTTC<br>CCCCCAAAACCCAAGGAC<br>ACCCTCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT<br>AATGCCAAGACAAAGCCG<br>CGGGAGGAGCAGTACAAC<br>AGCACGTACCGTGTGGTC<br>AGCGTCCTCACCGTCCTG<br>CACCAGGACTGGCTGAAT<br>GGCAAGGAGTACAAGTGC<br>AAGGTCTCCAACAAAGCC<br>CTCCCAGCCCCCATCGAG<br>AAAACCATCTCCAAAGCC<br>AAAGGGCAGCCCCGAGAA<br>CCACAGGTGTACACCCTG<br>CCCCCATCCCGGGATGAG<br>CTGACCAAGAACCAGGTC<br>AGCCTGACCTGCCTGGTC<br>AAAGGCTTCTATCCCAGC<br>GACATCGCCGTGGAGTGG<br>GAGAGCAATGGGCAGCCG<br>GAGAACAACTACAAGACC<br>ACGCCTCCGTGCTGGAC<br>TTATATTCAAAGCTCACC<br>GTGGACAAGAGCAGGTGG |
| | With leader [SEQ ID<br>NO: 264]:<br>MGWSCIILFLVATATGVHSQVQ<br>LVQSGAEVKKPGASVKVSCKAS<br>GYTFTTWITWVRQAPGQGLEW<br>MGDIYPGSSISNYAQKFQGRVT<br>MTRDTSTSTVYMELSSLRSEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br>Without leader [SEQ ID<br>NO: 265]:<br>QVQLVQSGAEVKKPGASVKVSC<br>KASGYTFTTWITWVRQAPGQG<br>LEWMGDIYPGSSISNYAQKFQG<br>RVTMTRDTSTSTVYMELSSLRS<br>EDTAVYYCAREDGYDAWFAYWG<br>QGTLVTVSSASTKGPSVFPLAP<br>SSKSTSGGTAALGCLVKDYFPE<br>PVTVSWNSGALITSGVHTFPAVL<br>QSSGLYSLSSVVTVPSSSLGTQ<br>TYICNVNHKPSNTKVDKKVEPK<br>SCDKTHTCPPCPAPELLGGPSV<br>FLPPKPKDTLMISRTPEVTCV<br>VVDVSHEDPEVKFNWYVDGVEV<br>HNAKTKPREEQYNSTYRVVSVL<br>TVLHQDWLNGKEYKCKVSNKAL<br>PAPIEKTISKAKGQPREPQVYT<br>LPPSRDELTKNQVSLTCLVKGF<br>YPSDIAVEWESNGQPENNYKTT<br>PPVLDSDGSFFLYSKLTVDKSR<br>WQQGNVFSCSVMHEALHNHYTQ<br>KSLSLSPGK | ATGGGCTG<br>GTCCTGCA<br>TCATCCTG<br>TTTCTGT<br>GGCCACCG<br>CCACCGGC<br>GTGCACAG<br>C<br>(Nucleotides<br>1 to 57 of<br>SEQ ID<br>NO: 262)<br>[SEQ ID<br>NO: 266] | |

TABLE 1-continued

AGCTGACTGCTGCCTGGTCAAAGGC
TTCTATCCCAGCACATGCCGTG
GAGTGGGAGAGCAATGGGCAGCCG
GAGAACAACTACAAGACCACGCCT
CCCGTGCTGGACTCCGACGGCTCC
TTCTTCTTATATTCAAAGCTCACC
GTGACAAGAGCAGGTGGCAGCAG
GGGAAGTCTTCTCATGCTCCGTG
ATGCATGAGGCTCTGCACAACCAC
TACACGCAGAAGAGCCCTCTCCCTG
TCTCCCGGGAAATGA

Without leader [SEQ ID
NO: 263]:
CAGGTGCAGCTGGTGCAGTCTGGC
GCCGAAGTGAAGAAACCTGGCGCC
TCCGTGAAGGTGTCCTGCAAGGCT
TCCGGCTACACCTTTACCACCTAC
TGGATCACCTGGGTGCGACAGGCT
CCTGGACAGGGCCTGGAATGGATG
GGCGACATCTACCCCGGCTCCTCC
ATCTCCAACTACGCCCAGAAGTTC
CAGGGCCGCGTGACCATGACCCGG
GACACCTCCACCAGCACCGTGTAC
ATGGAACTGTCCTCCCTGCGGAGC
GAGGACACCGCCGTGTACTACTGC
GCTAGAGAGGACGGCTACGACGGT
TGGTTTGCCTACTGGGGCCAGGGC
ACCCTCGTGACCGTGTCATCTGCA
TCCACCAAGGGCCCATCCGTCTTC
CCCCTGGCACCCTCCTCCAAGAGC
ACCTCTGGGGGCACAGCGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCCTGGGGGGACCG
TCAGTCTTCCTCTTCCCCCCAAAA
CCCAAGGACACCCTCATGATCTCC
CGGACCCCTGAGGTCACATGCGTG
GTGGTGGACGTGAGCCACGAAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC
CAGGACTGGCTGAATGGCAAGGAG CAGCAGGGGAACGTCTTC
TCATGCTCCGTGATGCAT
GAGGCTCTGCACAACCAC
TACACGCAGAAGAGCCCTC
TCCCTGTCTCCGGG
(Nucleotides 415
to 1401 of SEQ ID
NO: 262)
[SEQ ID NO: 269]
ASTKGPSVFPLAPSSKST
SGGTAALGCLVKDYFPEP
VTVSWNSGALTSGVHTFP
AVLQSSGLYSLSSVVTVP
SSSLGTQTYICNVNHKPS
NTKVDKKVEPKSCDKTHT
CPPCPAPELLGGPSVFLF
PPKPKDTLMISRTPEVTC
VVVDVSHEDPEVKFNWYV
DGVEVHNAKTKPREEQYN
STYRVVSVLTVLHQDWLN
GKEYKCKVSNKALPAPIE
KTISKAKGQPREPQVYTL
PPSRDELTKNQVSLTCLV
KGFYPSDIAVEWESNGQP
ENNYKTTPPVLDSDGSFF
LYSKLTVDKSRWQQGNVF
SCSVMHEALHNHYTQKSL
SLSPGK
[SEQ ID NO: 270]

TABLE 1-continued

| | | | |
|---|---|---|---|
| | TACAAGTGCAAGGTCTCCAACAAA GCCCTCCCAGCCCCCATCGAGAAA ACCATCTCCAAAGCCAAAGGGCAG CCCGAGAACCACCAGGTGTACACC CTGCCCCCATCCCGGGATGAGCTG ACCAAGAACCAGGTCAGCCTGACC TGCCTGGTCAAAGGCTTCTATCCC AGCGACATCGCCGTGGAGTGGGAG AGCAATGGGCAGCCGGAGAACAAC TACAAGACCACGCCTCCCGTGCTG GACTCCGACGGCTCCTTCTTCCTA TATTCAAAGCTCACCGTGGACAAG AGCAGGTGGCAGCAGGGGAACGTC TTCTCATGCTCCGTGATGCATGAG GCTCTGCACAACCACTACACGCAG AAGAGCCTCTCCCTGTCTCCGGGG AAATGA | | | |
| 7G6-HCzu9 | With leader [SEQ ID NO: 271]: ATGGGCTGGTCCTGCATCATCCTG TTTCTGGTGGCCACCGGCCACCGGC GTGCACAGCCAGGTGCAGCTGGTG CAGTCTGGCGCCTCCGTGAAGAAA CCTGGCGCCTCCGTGAAGGTGTCC TGCAAGGCTTCCGGCTACACCTTT ACCACTTACTGGATCACCTGGGTG CGACAGGCTCCTGGACAGGGCCTG GAATGGATGGGCGACATCTACCCC GGCTCCTCCATCTGCAACTACGCC CAGAAGTTCCAGGGCCGCGTGACC ATGACCGTGACACTGGAACTGTCC TCCCTGCGGAGCGAGGACACCGCC GTGTACTACTGCGCCAGAGAGGAC GGCTACGACGTTGGTTGCTACTGG GGCCAGGGCACCCTCGTGACCGTG TCATCTGCCAAGGGCCCATCTGTC TTCCCCCTGGCACCCTCCTCCAAG TCCACAAGCGGCACCGCCGCCCTG GGCTGCCTGGTCAAGGACTACTTC CCCGAACCGGTGACGGTGTCGTGG AACTCAGGCGCCCTGACCAGCGGC GTGCACACCTTCCCGGCTGTCCTA CAGTCCTCAGGACTCTACTCCCTC AGCAGCGTGGTGACCGTGCCCTCC AGCAACTTCGGCACCCAGACCTAC ACCTGCAACGTAGATCACAAGCCC AGCAACACCAAGGTGGACAAGACA GTGGAACGCAAATCT (Nucleotides 1 to 57 of SEQ ID NO: 271) Nucleotides 58 to 414 of SEQ ID NO: 271) [SEQ ID NO: 275] | ATGGGCTG GTCCTGCA TCATCCTG TTTCTGGT GGCCACCG GCCACCGGC GTGCACAG C | CAGGTGCAGCTGGTGCAG TCTGGCGCCTCCAAGTGAAG AAACCTGGCGCCTCCGTG AAGGTGTCCTGCAAGGCT TCCGGCTACACCTTTACC ACTTACTGGATCACCTGG GTGCGACAGGCTCCTGGA CAGGGCCTGGAATGGATG GGCGACATCTACCCCGGC TCCTCCATCTGCAACTAC GCCCAGAAGTTCCAGGGC CGCGTGACCATGACCGTG GACACCGTGTACATGGAACTGTCC TCCCTGCGGAGCGAGGAC ACCGCCGTGTACTACTGC GCTAGAGAGGACGGCTAC GACGTTGGTTGCTACTAC TGGGGCCAGGGCACCCTC GTGACCGTGTCATCT [SEQ ID NO: 276] QVQLVQSGAEVKKPGASV KVSCKASGYTFTTYWITW VRQAPGQGLEWMGDIYPG SSICNYAQKFQGRVTMTV DTSTSTVYMELSSLRSED TAVYYCAREDGYDAWFAY WGQGTLVTVSS [SEQ ID NO: 277] |
| | With leader [SEQ ID NO: 273]: MGWSCIILFLVATATGVHSQVQ LVQSGAEVKKPGASVKVSCKAS GYTFTTYWITWVRQAPGQGLEW MGDIYPGSSICNYAQKFQGRVT MTVDTSTSTVYMELSSLRSEDT AVYYCAREDGYDAWFAYWGQGT LVTVSSASTKGPSVFPLAPSSK STSGGTAALGCLVKDYFPEPVT VSWNSGALTSGVHTFPAVLQSS GLYSLSSVVTVPSSSLGTQTYI CNVNHKPSNTKVDKKVEPKSCD KTHTCPPCPAPELLGGPSVFLF PPKPKDTLMISRTPEVTCVVVD VSHEDPEVKFNWYVDGVEVHNA KTKPREEQYNSTYRVVSVLTVL HQDWLNGKEYKCKVSNKALPAP IEKTISKAKGQPREPQVVTLPP SRDELTKNQVSLTCLVKGFYPS DIAVEWESNGQPENNYKTTPPV LDSDGSFFLYSKLTVDKSRWQQ GNVFSCSVMHEALHNHYTQKSL SLSPGK Without leader [SEQ ID NO: 274]: QVQLVQSGAEVKKPGASVKVSC KASGYTFTTYWITWVRQAPGQG LEWMGDIYPGSSICNYAQKFQG RVTMTVDTSTSTVYMELSSLRS EDTAVYYCAREDGYDAWFAYWG QGTLVTVSSASTKGPSVFPLAP SSKSTSGGTAALGCLVHTFPPE PVTVSWNSGALTSGVHTFPAVL QSSGLYSLSSVVTVPSSSLGTQ | | |

TABLE 1-continued

| | | |
|---|---|---|
| CCCCAAAACCCAAGGACACCCTC | TYICNVNHKPSNTKVDKKVEPK | CTCCCAGCCCCCATCGAG |
| ATGATCTCCCGGACCCCTGAGGTC | SCDKTHTCPPCPAPELLGGPSV | AAAACCATCCAAAGCC |
| ACATCCGTGGTGGACGTGAGC | FLFPPKPKDTLMISRTPEVTCV | AAAGGCAGCCCCGAGAA |
| CACGAAGACCCTGAGGTCAAGTTC | VVDVSHEDPEVKFNWYVDGVEV | CCACAGGTGTACACCCTG |
| AACTGGTACGTGGACGGCGTGGAG | HNAKTKPREEQYNSTYRVVSVL | CCCCCATCCGGGATGAG |
| GTGCATAATGCCAAGACAAAGCCG | TVLHQDWLNGKEYKCKVSNKAL | CTGACCAAGAACCAGGTC |
| CGGGAGGAGCAGTACAACAGCACG | PAPIEKTISKAKGQPREPQVYT | AGCCTGACCTGCCTGGTC |
| TACCGTGGTCAGCGTCCTCACC | LPPSRDELTKNQVSLTCLVKGF | AAAGGCTTCTATCCCAGC |
| GTCCTGCACCAGGACTGGCTGAAT | YPSDIAVEWESNGQPENNYKTT | GACATCGCCGTGGAGTGG |
| GGCAAGGAGTACAAGTGCAAGGTC | PPVLDSDGSFFLYSKLTVDKSR | GAGAGCAATGGGCAGCCG |
| TCCAACAAAGCCCTCCCAGCCCCC | WQQGNVFSCSVMHEALHNHYTQ | GAGAACAACTACAAGACC |
| ATCGAGAAAACCATCTCCAAAGCC | KSLSLSPGK | ACGCCTCCCGTGCTGGAC |
| AAAGGGCAGCCCCGAGAACCACAG | | TCCGACGGCTCCTTCTTC |
| GTGTACACCCTGCCCCCATCCCGG | | TTATATTCAAAGCTTCACC |
| GATGAGCTGACCAAGAACCAGGTC | | GTGGACAAGAGCAGGTGG |
| AGCCTGACCTGCCTGGTCAAAGGC | | CAGCAGGGGAACGTCTTC |
| TTCTATCCCAGCGACATCGCCGTG | | TCATGCTCCGTGATGCAT |
| GAGTGGGAGAGCAATGGGCAGCCG | | GAGGCTCTGCACAACCAC |
| GAGAACAACTACAAGACCACGCCT | | TACACGCAGAAGAGCCTC |
| CCCGTGCTGGACTCCGACGGCTCC | | TCCCTGTCTCCGGG |
| TTCTTCTTATATTCAAAGCTTCACC | | (Nucleotides 415 |
| GTGGACAAGAGCAGGTGGCAGCAG | | to 1401 of SEQ ID |
| GGGAACGTCTTCTCATGCTCCGTG | | NO: 271) |
| ATGCATGAGGCTCTGCACAACCAC | | |
| TACACGCAGAAGAGCCTCTCCCTG | | [SEQ ID NO: 278] |
| TCTCCGGGAAATGA | | ASTKGPSVFPLAPSSKST |
| Without leader [SEQ ID | | SGGTAALGCLVKDYFPEP |
| NO: 272]: | | VTVSWNSGALTSGVHTFP |
| CAGGTGCAGCTGGTGCAGTCTGGC | | AVLQSSGLYSLSSVVTVP |
| GCCGAAGTGAAGAAACCTGGCGCC | | SSSLGTQTYICNVNHKPS |
| TCCGTGAAGGTGTCCTGCAAGGCT | | NTKVDKKVEPKSCDKTHT |
| TCCGGCTACACCTTTACCACCTAC | | CPPCPAPELLGGPSVFLF |
| TGGATCACCTGGGTGCGACAGGCT | | PPKPKDTLMISRTPEVTC |
| CCTGGACAGGGCCTGGAATGGATG | | VVDVSHEDPEVKPNWYV |
| GGGACATCTACCCCGGCTCCTCC | | DGVEVHNAKTKPREEQYN |
| ATCTCAACTACGCCCAGAAGTTC | | STYRVVSVLTVLHQDWLN |
| CAGGGCCGCGTGACCATGACCGTG | | GKEYKCKVSNKALPAPIE |
| GACACCTCCACCAGCACCGTGTAC | | KTISKAKGQPREPQVYTL |
| ATGGAACTGTCCCTGCGGAGC | | PPSRDELTKNQVSLTCLV |
| GAGGACACCGGTGACGGTCGTGG | | KGFYPSDIAVEWESNGQP |
| AACTCAGGGCGCCCTGACCGGC | | ENNYKTTPPVLDSDGSFF |
| GTGCACACCTTCCCGGCTGTCCTA | | LYSKLTVDKSRWQQGNVF |
| CAGTCCTCAGGACTCTACTCCCTC | | SCSVMHEALHNHYTQKSL |
| AGCAGCGTGGTGACCGTGCCCTCC | | SLSPGK |
| AGCAGCTTGGGCACCCAGACCTAC | | [SEQ ID NO: 279] |

TABLE 1-continued

| | | |
|---|---|---|
| | ATCTGCAACGTGAATCAAGCCC<br>AGCAACACCAAGTGGACAAGAA<br>GTTGAGCCCAAATGCCACCGTGCCCA<br>ACTCACACAGCCCACCGTGCCCA<br>GCACCTGAACTCCTGGGGGACCG<br>TCAGTCTTCCTCTTCCCCCCAAAA<br>CCCAAGGACACCCTCATGATCTCC<br>CGGACCCCTGAGGTCACATGCGTG<br>GTGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCCTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | | |
| 7G6-<br>HCzu10 | With leader [SEQ ID<br>NO: 280]:<br>ATGGGGTGGTCCTGCATCATCCTG<br>TTTCTGGTGGCCACCGCCACCGGC<br>GTGCACAGCCAGGTGCAGCTGGTG<br>CAGTCTGGCGCCGAAGTGAAGAAA<br>CCTGGCGCCAGCGTGAAGGTGTCC<br>TGCAAGGCTTCCGGCTACACCTTT<br>ACCACCTACTGGATCACCTGGGTG<br>CGACAGGCTCCTGGACAGGGCCTG<br>GAATGGATGGGCGATATCTACCCC<br>GGCTCCTCCATCTGCAACTACGCC<br>CAGAAGTTCCAGGGCCGCGTGACC<br>ATGACCCGGGACACCTCCACCAGC<br>ACCGTGTACATGGAACTGTCCTCC<br>CTGCGGAGCGAGGACACCGCCGTG<br>TACTACTGCGCTAGAGAGGACGGC<br>TACGACGTTGGTTTGCCTACTGG<br>GGCCAGGGCACCCTGGTCACCGTG<br>TCATCTGCATCCACCAAGGGCCCA | With leader [SEQ ID<br>NO: 282]:<br>MGWSCIILFLVATATGVHSQVQ<br>LVQSGAEVKKPGASVKVSCKAS<br>GYTFTTYWITWVRQAPGQGLEW<br>MGDIYPGSSICNYAQKFQGRVT<br>MTRDTSTSTVYMELSSLRSEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAGQPREPQVYTLPP<br>SRDELTKNQVSLTCLVKGFYPS | CAGGTGCAGCTGGTGCAG<br>TCTGGCGCCGAAGTGAAG<br>AAACCTGGCGCCTCCGTG<br>AAGGTGTCCTGCAAGGCT<br>TCCGGCTACACCTTTACC<br>ACCTACTGGATCACCTGG<br>GTGCGACAGGCTCCTGGA<br>CAGGGCCTGGAATGGATG<br>GGCGACATCTACCCCGGC<br>TCCTCCATCTGCAACTAC<br>GCCCAGAAGTTCCAGGGC<br>CGCGTGACCATGACCCGG<br>GACACCTCCACCAGCACC<br>GTGTACATGGAACTGTCC<br>TCCCTGCGGAGCGAGGAC<br>ACCGCCGTGTACTACTGC<br>GCTAGAGAGGACGGCTAC<br>GACGCTTGGTTTGCCTAC<br>TGGGGCCAGGGCACCCTC<br>GTGACCGTGTCATCT | GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGGA |

TABLE 1-continued

| | | |
|---|---|---|
| TCGTCTCTTCCCCTGGCACCCTCC | DIAVEWESNGQPENNYKTPPV | (Nucleotides 58 to | CCGTCAGTCTTCCTCTTC |
| TCCAAGAGACACCTCTGGGGGCACA | LDSDGSFFLYSKLTVDKSRWQQ | 414 of SEQ ID NO: | CCCCCAAAACCCAAGGAC |
| GCGCCCTGGGCTGCCTGGTCAAG | GNVFSCSVMHEALHNHYTQKSL | 280) | ACCCTCATGATCTCCCGG |
| GACTACTTCCCCGAACCGGTGACG | SLSPGK | | ACCCCTGAGGTCACATGC |
| GTGTCGTGGAACTCAGGCGCCCTG | Without leader [SEQ ID | [SEQ ID NO: 285] | GTGGTGGTGGACGTGAGC |
| ACCAGCGGCGTGCACACCTTCCCG | NO: 283]: | | CACGAAGACCCTGAGGTC |
| GCTGTCCTACAGTCCTCAGGACTC | QVQLVQSGAEVKKPGASVKVSC | QVQLVQSGAEVKKPGASV | AAGTTCAACTGGTACGTG |
| TACTCCCTCAGCAGCGTGGTGACC | KASGYTFTTYWITWVRQAPGQG | KVSCKASGYTFTTYWITW | GACGGCGTGGAGGTGCAT |
| GTGCCCTCCAGCAGCTTGGGCACC | LEWMGDIYPGSSICNYAQKFQG | VRQAPGQGLEWMGDIYPG | AATGCCAAGACAAAGCCG |
| CAGACCTACATCTGCAACGTGAAT | RVTMTRDTSTSTVYMELSSLRS | SSICNYAQKFQGRVTMTR | CGGGAGGAGCAGTACAAC |
| CACAAGCCCAGCAACACCAAGGTG | EDTAVYYCAREDGYDAWFAYWG | DTSTSTVYMELSSLRSED | AGCAGTACCGTGTGGTC |
| GACAAGAAAGTTGAGCCCAAATCT | QGTLVTVSSASTKGPSVFPLAP | TAVYYCAREDGYDAWFAY | AGCGTCCTCACCGTCCTG |
| TGTGACAAAACTCACACATGCCCA | SSKSTSGGTAALGCLVKDYFPE | WGQGTLVTVSS | CACCAGGACTGGCTGAAT |
| CCGTGCCCAGCACCTGAACTCCTG | PVTVSWNSGALITSGVHTFPAVL | [SEQ ID NO: 286] | GGCAAGGAGTACAAGTGC |
| GGGGGACCGTCAGTCTTCCTCTTC | QSSGLYSLSSVVTVPSSSLGTQ | | AAGGTCTCCAACAAAGCC |
| CCCCCAAAACCCAAGGACACCCTC | TYICNVNHKPSNTKVDKKVEPK | | CTCCCAGCCCCCATCGAG |
| ATGATCTCCCGGACCCCTGAGGTC | SCDKTHTCPPCPAPELLGGPSV | | AAAACCATCTCCAAAGCC |
| ACATGCGTGGTGGTGGACGTGAGC | FLFPPKPKDTLMISRTPEVTCV | | AAAGGGCAGCCCCGAGAA |
| CACGAAGACCCTGAGGTCAAGTTC | VVDVSHEDPEVKFNWYVDGVEV | | CCACAGGTGTACACCCTG |
| AACTGGTACGTGGACGGCGTGGAG | HNAKTKPREEQYNSTYRVVSVL | | CCCCCATCCCGGGATGAG |
| GTGCATAATGCCAAGACAAAGCCG | TVLHQDWLNGKEYKCKVSNKAL | | CTGACCAAGAACCAGGTC |
| CGGGAGGAGCAGTACAACAGCACG | PAPIEKTISKAKGQPREPQVYT | | AGCCTGACCTGCCTGGTC |
| TACCGTGTGGTCAGCGTCCTCACC | LPPSRDELTKNQVSLTCLVKGF | | AAAGGCTTCTATCCCAGC |
| GTCCTGCACCAGGACTGGCTGAAT | YPSDIAVEWESNGQPENNYKTT | | GACATCGCCGTGGAGTGG |
| GGCAAGGAGTACAAGTGCAAGGTC | PPVLDSDGSFFLYSKLTVDKSR | | GAGAGCAATGGGCAGCCG |
| TCCAACAAAGCCCTCCCAGCCCCC | WQQGNVFSCSVMHEALHNHYTQ | | GAGAACAACTACAAGACC |
| ATCGAGAAAACCATCTCCAAAGCC | KSLSLSPGK | | ACGCCTCCCGTGCTGGAC |
| AAAGGGCAGCCCCGAGAACCACAG | | | TCCGACGGCTCCTTCTTC |
| GTGTACACCCTGCCCCCATCCCGG | | | TTATATTCAAAGCTCACC |
| GATGAGCTGACCAAGAACCAGGTC | | | GTGGACAAGAGCAGGTGG |
| AGCCTGACCTGCCTGGTCAAAGGC | | | CAGCAGGGGAACGTCTTC |
| TTCTATCCCAGCGACATCGCCGTG | | | TCATGCTCCGTGATGCAT |
| GAGTGGGAGAGCAATGGGCAGCCG | | | GAGGCTCTGCACAACCAC |
| GAGAACAACTACAAGACCACGCCT | | | TACACGCAGAAGAGCCTC |
| CCCGTGCTGGACTCCGACGGCTCC | | | TCCCTGTCTCCGGG |
| TTCTTCTTATATTCAAAGCTCACC | | (Nucleotides 415 | |
| GTGGACAAGAGCAGGTGGCAGCAG | | to 1401 of SEQ ID | |
| GGGAACGTCTTCTCATGCTCCGTG | | NO: 280) | |
| ATGCATGAGGCTCTGCACAACCAC | | | |
| TACACGCAGAAGAGCCTCTCCCTG | | [SEQ ID NO: 287] | |
| TCTCCGGGTAAATGA | | ASTKGPSVFPLAPSSKST | |
| Without leader [SEQ ID | | SGGTAALGCLVKDYFPEP | |
| NO: 281]: | | VTVSWNSGALTSGVHTFP | |
| CAGGTGCAGCTGGTGCAGTCTGGC | | AVLQSSGLYSLSSVVTVP | |
| GCCGAAGTGAAGAAACCTGGCGCC | | SSSLGTQTYICNVNHKPS | |
| TCCGTGAAGGTGTCCTGCAAGGCT | | NTKVDKKVEPKSCDKTHT | |
| TCCGGCTACACCTTTACCACCTAC | | CPPCPAPELLGGPSVFLF | |
| TGGATCACCTGGGTGCGACAGGCT | | PPKPKDTLMISRTPEVTC | |
| CCTGGACAGGGCCTGGAATGGATG | | VVDVSHEDPEVKFNWYV | |
| GGCGACATCTACCCCGGCTCCTCC | | DGVEVHNAKTKPREEQYN | |
| ATCTGCAACTACGCCCAGAAGTTC | | STYRVVSVLTVLHQDWLN | |
| CAGGGCCGCGTGACCATGACCCGG | | GKEYKCKVSNKALPAPIE | |
| GACACCTCCACCAGCACCGTGTAC | | KTISKAKGQPREPQVYTL | |
| | | PPSRDELTKNQVSLTCLV | |

TABLE 1-continued

| | | | |
|---|---|---|---|
| | ATGAACTGTCCTCCCTGCGAGC<br>GAGGACACCGCCCTGTACTACTGC<br>GCTAGAGAGGACGGCTACACGCT<br>TGTTTGCCTACTGGGGCCAGGGC<br>ACCCTCGTGACCGTGTCATCTGCA<br>TCCACCAAGGGCCCATCCTGCTTC<br>CCCCTGGCACCCTCCAAGAGC<br>ACCTCTGGGGCACAGCGGCCCTG<br>GGCTGCCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTA<br>CAGTCCTCAGGACTCTACTCCCTC<br>AGCAGCGTGGTGACCGTGCCCTCC<br>AGCAGCTTGGGCACCCAGACCTAC<br>ATCTGCAACGTGAATCACAAGCCC<br>AGCAACACCAAGGTGGACAAGAAA<br>GTTGAGCCCAAATCTGCACAAA<br>ACTCACACACATGCCCACCGTGCCA<br>GCACCTGAACTCCTGGGGGGACCG<br>TCAGTCTTCCTCTTCCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCTTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | | KGFYPSDIAVEWESNGQP<br>ENNYKTTPPVLDSDGSFF<br>LYSKLTVDKSRWQQGNVF<br>SCSVMHEALHNHYTQKSL<br>SLSPGK<br>[SEQ ID NO: 288] |
| 7G6-<br>HCzu11 | With leader [SEQ ID NO:<br>289]:<br><u>ATGGGCTGGTCCTGCATCATCCTG</u><br><u>TTTCTGGTGGCCGCCACCGGC</u><br><u>GTGCACAGC</u>GAAGTGCAGCTGCTG | With leader [SEQ ID<br>NO: 291]:<br>MGWSCIILFLVATATGVHSEVQ<br>LLESGGGLVQPGGSLRLSCAAS<br>GYTFTTYWITWVRQAPGKGLEW | ATGGGCTG<br>GTCCTGCA<br>TCATCCTG<br>TTTCTGGT<br>GGCCACCG | GAAGTGCAGCTGCTGGAA<br>TCTGGCGGCGGACTGGTG<br>CAGCCTGGCGGCTCTCTG<br>AGACTGTCTTGTGCCGCC<br>TCCGGCTACACCTTCACC | GCATCCACCAAGGGCCCA<br>TCGGTCTTCCCCCTGGCA<br>CCCTCCTCCAAGAGCACC<br>TCTGGGGCACAGCGGCC<br>CTGGGCTGCCTGGTCAAG |

TABLE 1-continued

| | | | |
|---|---|---|---|
| GAATCTGGCGGCCGACTGTGCAG | VSDIYPGSSICNYNEKFKSRFT | CCACCGGC | ACCTACTGGATCACCTGG | GACTACTTCCCGAACCG |
| CCTGGCGGCTCTCGAGACTGTCT | ISRDNSKNTLYLQMNSLRAEDT | GTGCACAG | GTCCGACAGGCTCCCGGC | GTGACGGTCGTGGAAC |
| TGTCCGCCTCCCGCTACACCTTC | AVYYCAKEDGYDAMFAYWGQGT | C | AAGGGACTGAATGGGTG | TCAGGCGCCCTGACCAGC |
| ACCACTACTGGATCACCTGGGTC | LVTVSSASTKGPSVFPLAPSSK | (Nucleotides | TCCGACATCTACCCGGC | GGCTGCACACCTTCCCG |
| CGACAGGCTCCCGGCAAGGGACTG | STSGGTAALGCLVKDYFPEPVT | 1 | TCCTCCATCTGCAACTAC | GCTGTCCTACAGTCCTCA |
| GAATGGGTGTCCGACATCTACCCC | VSWNSGALTSGVHTFPAVLQSS | to 57 of | AACGAGAAGTTCAAGTCC | GGACTCTACTCCCTCAGC |
| GGCTCCTCCATCTGCAACTACAAC | GLYSLSSVVTVPSSLGTQTYI | SEQ ID | CGGTTCACCATCTCCCGG | AGCGGTGACCGTGCC |
| GAGAAGTTCAAGTCCCGGTTCACC | CNVNHKPSNTKVDKKVEPKSCD | NO: 289) | GACAACTCCAAGAACACC | TCCAGCAGCTTGGGCACC |
| ATCTCCCGGGACAACTCCAAGAAC | KTHTCPPCPAPELLGGPSVFLF |  | CTGTACCTGCGGGCCGAGGAC | CAGACCTACATCTGCAAC |
| ACCCTGTACCTGCAGATGAACTCC | PPKPKDTLMISRTPEVTCVVVD | [SEQ ID | TCCCTGCGGGCCGAGGAC | GTGAATCACAAGCCCAAC |
| CTGCGGGCCGAGGACACCGCCGTG | VSHEDPEVKFNWYVDGVEVHNA | NO: 293] | ACCGCCGTGTACTACTGT | AACACCAAGGTGGACAAG |
| TACTACTGTGCCAAAGAGGACGGC | KTKPREEQYNSTYRVVSVLTVL |  | GCCAAAGAGGACGGCTAC | AAAGTTGAGCCCAAATCT |
| TACGACGCTTGGTTTGCCTACTGG | HQDWLNGKEYKCKVSNKALPAP |  | GACGCTTGGTTTGCCTAC | TGTGACAAAACTCACACA |
| GGCCAGGGCACCCTGGTCACCGTG | IEKTISKAKGQPREPQVYTLPP |  | TGGGGCCAGGGCACCCTG | TGCCCACCGTGCCCAGCA |
| TCATCTGCATCCACCAAGGGCCCA | SRDELTKNQVSLTCLVKGFYPS |  | GTCACCGTGTCATCT | CCTGACCTGCCTGGGGA |
| TCGGTCTTCCCCCTGGCACCTCC | DIAVEWESNGQPENNYKTTPPV |  | (Nucleotides 58 to | CCGTCAGTCTTCCTCTTC |
| TCCAAGAGCACCTCTGGGGGCACA | LDSDGSFFLYSKLTVDKSRWQQ |  | 414 of SEQ ID NO: | CCCCCAAAACCCAAGGAC |
| GCGGCCCTGGGCTGCCTGGTCAAG | GNVFSCSVMHEALHNHYTQKSL |  | 289) | ACCCTCATGATCTCCCGG |
| GACTACTTCCCCGAACCGGTGACG | SLSPGK |  |  | GTGGTGGTGGACGTGAGC |
| GTGTCGTGGAACTCAGGCGCCCTG | Without leader [SEQ ID |  | [SEQ ID NO: 294] | CACGAAGACCCTGAGGTC |
| ACCAGCGGCGTGCACACCTTCCCG | NO: 292]: |  | EVQLLESGGGLVQPGGSL | AAGTTCAACTGGTACGTG |
| GCTGTCCTACAGTCCTCAGGACTC | EVQLLESGGGLVQPGGSLRLSC |  | RLSCAASGYTFTTYWITW | GACGGCGTGGAGGTGCAT |
| TACTCCCTCAGCAGCGTGGTGACC | AASGYTFTTYWITWVRQAPGKG |  | VRQAPGKGLEWVSDIYPG | AATGCCAAGACAAAGCCG |
| GTGCCCTCCAGCAGCTTGGGCACC | LEWVSDIYPGSSICNYNEKFKS |  | SSICNYNEKFKSRFTISR | CGGGAGGAGCAGTACAAC |
| CAGACCTACATCTGCAACGTGAAT | RFTISRDNSKNTLYLQMNSLRA |  | DNSKNTLYLQMNSLRAED | AGCACGTACCGTGTGGTC |
| CACAAGCCCAGCAACACCAAGGTG | EDTAVYYCAKEDGYDAWFAYWG |  | TAVYYCAKEDGYDAWFAY | AGCGTCCTCACCGTCCTG |
| GACAAGAAGTTGAGCCCAAATCT | QGTLVTVSSASTKGPSVFPLAP |  | WGQGTLVTVSS | CACCAGGACTGGCTGAAT |
| TGTGACAAAACTCACACATGCCCA | SSKSTSGGTAALGCLVKDYFPE |  |  | GGCAAGGAGTACAAGTGC |
| CCGTGCCCAGCACCTGAACTCCTG | PVTVSWNSGALTSGVHTFPAVL |  | [SEQ ID NO: 295] | AAGGTCTCCAACAAAGCC |
| GGGGGACCGTCAGTCTTCCTCTTC | QSSGLYSLSSVVTVPSSSLGTQ |  |  | CTCCAGCCCCATCGAG |
| CCCCCAAAACCCAAGGACACCCTC | TYICNVNHKPSNTKVDKKVEPK |  |  | AAAACCATCTCCAAAGCC |
| ATGATCTCCCGGACCCCTGAGGTC | SCDKTHTCPPCPAPELLGGPSV |  |  | AAAGGGCAGCCCCGAGAA |
| ACATGCGTGGTGGTGGACGTGAGC | FLPPKPKDTLMISRTPEVTCV |  |  | CCACAGGTGTACACCCTG |
| CACGAAGACCCTGAGGTCAAGTTC | VVDVSHEDPEVKFNWYVDGVEV |  |  | CCCCCATCCCGGGATGAG |
| AACTGGTACGTGGACGGCGTGGAG | HNAKTKPREEQYNSTYRVVSVL |  |  | CTGACCAAGAACCAGGTC |
| GTGCATAATGCCAAGACAAAGCCG | TVLHQDWLNGKEYKCKVSNKAL |  |  | AGCCTGACCTGCCTGGTC |
| CGGGAGGAGCAGTACAACAGCACG | PAPIEKTISKAKGQPREPQVYT |  |  | AAAGGCTTCTATCCCAGC |
| TACCGTGTGGTCAGCGTCCTCACC | LPPSRDELTKNQVSLTCLVKGF |  |  | GACATCGCCGTGGAGTGG |
| GTCCTGCACCAGGACTGGCTGAAT | YPSDIAVEWESNGQPENNYKTT |  |  | GAGAGCAATGGGCAGCCG |
| GGCAAGGAGTACAAGTGCAAGGTC | PPVLDSDGSFFLYSKLTVDKSR |  |  | GAGAACAACTACAAGACC |
| TCCAACAAAGCCCTCCAGCCC | WQQGNVFSCSVMHEALHNHYTQ |  |  | ACGCCTCCGTGCTGGAC |
| ATCGAGAAAACCATCTCCAAAGCC | KSLSLSPGK |  |  | TCCGACGGCTCCTTCTTC |
| AAAGGGCAGCCCCGAGAACCACAG |  |  |  | TTATATTCAAAGCTCACC |
| GTGTACACCCTGCCCCCATCCCGG |  |  |  | GTGGACAAGAGCAGGTGG |
| GATGAGCTGACCAAGAACCAGGTC |  |  |  | CAGCAGGGGAACGTCTTC |
| AGCCTGACCTGCCTGGTCAAAGGC |  |  |  | TCATGCTCCGTGATGCAT |
| TTCTATCCCAGCGACATCGCCGTG |  |  |  | GAGGCTCTGCACAACCAC |
| GAGTGGGAGAGCAATGGGCAGCCG |  |  |  | TACACGCAGAAGAGCCTC |
| GAGAACAACTACAAGACCACGCCT |  |  |  | TCCCTGTCTCCGGG |
| CCCGTGCTGGACTCCGACGGCTCC |  |  |  | (Nucleotides 415 |
| TTCTTCCTCTATATTCAAAGCTCACC |  |  |  | to 1401 of SEQ ID |
| GTGGACAAGAGCAGGTGGCAGCAG |  |  |  | NO: 289) |
| GGGAACGTCTTCTCATGCTCCGTG |  |  |  |  |

TABLE 1-continued

Without leader [SEQ ID NO: 290]:

ATGCATGAGGCTCTGCACAACCAC
TACACGCAGAAGAGCCTCTCCCTG
TCTCCCGGGAAATGA

GAAGTGCAGCTGCTGGAATCTGGC
GGCGGACTGGTGCAGCCTGGCGGC
TCTCTGAGACTGTCTTGTGCCGCC
TCCGGCTACACCTTCACCACCTAC
TGGATCAACTGGGTCCGACAGGCT
CCCGGCAAGGACTGGAATGGGTG
TCCGACATCTACCCCGGCTCCTCC
ATCTGCAACTACAACGAGAAGTTC
AAGTCCCGGTTCACCATCTCCCGG
GACAACTCCAAGAACACCCTGTAC
CTCCAGATGAACTCCCTGCGGGCC
GAGGACACCGCCGTGTACTACTGT
GCCAAAGAGGACGGCTACGACGCT
TGGTTTGCCTACTGGGGCCAGGGC
ACCCTGGTCACCGTGTCATCTGCA
TCCACCAAGGGCCCATCGGTCTTC
CCCCTGGCACCCTCCTCCAAGAGC
ACCTCTGGGGGCACAGCGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCCTGGGGGGACCG
TCAGTCTTCCTCTTCCCCCCAAAA
CCCAAGGACACCCTCATGATCTCC
CGGACCCCTGAGGTCACATGCGTG
GTGGTGGACGTGAGCCACGAAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC
CAGGACTGGCTGAATGGCAAGGAG
TACAAGTGCAAGGTCTCCAACAAA
GCCCTCCCAGCCCCCATCGAGAAA
ACCATCTCCAAAGCCAAAGGGCAG
CCCCGAGAACCACAGGTGTACACC
CTGCCCCCATCCCGGGATGAGCTG
ACCAAGAACCAGGTCAGCCTGACC
TGCCTGGTCAAAGGCTTCTATCCC
AGCGACATCGCCGTGGAGTGGGAG

[SEQ ID NO: 296]
ASTKGPSVFPLAPSSKST
SGGTAALGCLVKDYFPEP
VTVSWNSGALTSGVHTFP
AVLQSSGLYSLSSVVTVP
SSSLGTQTYICNVNHKPS
NTKVDKKVEPKSCDKTHT
CPPCPAPELLGGPSVFLF
PPKPKDTLMISRTPEVTC
VVVDVSHEDPEVKFNWYV
DGVEVHNAKTKPREEQYN
STYRVSVLTVLHQDWLN
GKEYKCKVSNKALPAPIE
KTISKAKGQPREPQVYTL
PPSRDELTKNQVSLTCLV
KGFYPSDIAVEWESNGQP
ENNYKTTPPVLDSDGSFF
LYSKLTVDKSRWQQGNVF
SCSVMHEALHNHYTQKSL
SLSPGK
[SEQ ID NO: 297]

TABLE 1-continued

| | | | |
|---|---|---|---|
| | AGCAATGGGCAGCCGCCGGAGAACAAC<br>TACAAGACCACGCCTCCCGTGCTG<br>GACTCCGACGGCTCCTTCTTCTTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCCGGG<br>AAATGA | | | |
| 7G6-HCzu12 | With leader [SEQ ID NO: 298]:<br>ATGGGCTGTCCTGCATCATCCTG<br>TTTCTGGTGGCCACCGGCCACCGGC<br>GTGCACAGCGAAGTGCAGCTGCTG<br>GAATCTGGCGGCGGACTGGTGCAG<br>CCTGGCGGCTCTCTGAGACTGTCT<br>TGTGCCGCCTCCGGCTACACCTTC<br>ACCACTTACTGGATCACCTGGGTC<br>CGACAGGCTCCCGGCAAGGGACTG<br>GAATGGGTCGGAGACATCTACCCC<br>GGCTCCTCCATCTGCAACTACAAC<br>GAGAAGTTCAAGTCCCGGTTCACC<br>ATCTCCGTGGACAACTCCAAGTCC<br>ACCGCCTACCTCCAGATGAACTCC<br>CTGAGAGCCGAGGACACCGCCGTG<br>TACTACTGCGCCAGAGAGGACGCC<br>TACGACGCTTGGTTTGCTTACTGG<br>GGCCAGGGCACCCTGGTCACCGTG<br>TCATTCGATCCACCAAGGGCCCA<br>TCCGTCTTCCCCCTGGCACCCTCC<br>TCCAAGAGCACCTCTGGGGCACA<br>GCCGCTCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC<br>GTGCCCTCCAGCAGCTTGGGCACC<br>CAGACCTACATCTGCAACGTGAAT<br>CACAAGCCCAGCAACACCAAGGTG<br>GACAAGAAAGTTGAGCCCAAATCT<br>TGTGACAAAACTCACACATGCCCA<br>CCGTGCCCAGCACCTGAACTCCTG<br>GGGGGACCGTCAGTCTTCCTCTTC<br>CCCCCAAAACCCAAGGACACCCTC<br>ATGATCTCCCGGACCCCTGAGGTC<br>ACATGCGTGGTGGTGGACGTGAGC<br>CACGAAGACCCTGAGGTCAAGTTC<br>AACTGGTACGTGGACGGCGTGGAG<br>GTGCATAATGCCAAGACAAAGCCG<br>CGGGAGGAGCAGTACAACAGCACG<br>TACCGTGTGGTCAGCGTCCTCACC | With leader [SEQ ID NO: 300]:<br>MGWSCIILFLVATATGVHSEVQ<br>LLESGGGLVQPGGSLRLSCAAS<br>GYTFTTYWITWVRQAPGKGLEW<br>VGDIYPGSSICNYNEKFKSRFT<br>ISVDNSKSTAYLQMNSLRAEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br>Without leader [SEQ ID NO: 301]:<br>EVQLLESGGGLVQPGGSLRLSC<br>AASGYTFTTYWITWVRQAPGKG<br>LEWVGDIYPGSSICNYNEKFKS<br>RFTISVDNSKSTAYLQMNSLRA<br>EDTAVYYCAREDGYDAWFAYWG<br>QGTLVTVSSASTKGPSVFPLAP<br>SSKSTSGGTAALGCLVKDYFPE<br>PVTVSWNSGALTSGVHTFPAVL<br>QSSGLYSLSSVVTVPSSSLGTQ<br>TYICNVNHKPSNTKVDKKVEPK<br>SCDKTHTCPPCPAPELLGGPSV<br>FLFPPKPKDTLMISRTPEVTCV<br>VVDVSHEDPEVKFNWYVDGVEV<br>HNAKTKPREEQYNSTYRVVSVL<br>TVLHQDWLNGKEYKCKVSNKAL<br>PAPIEKTISKAKGQPREPQVYT<br>LPPSRDELTKNQVSLTCLVKGF | GAAGTGCAGCTGCTGGAA<br>TCTGGCGGCGGACTGGTG<br>CAGCCTGGCGGCTCTCTG<br>AGACTGTCTTGTGCCGCC<br>TCCGGCTACACCTTCACC<br>ACTTACTGGATCACCTGG<br>GTCCGACAGGCTCCCGGC<br>AAGGGACTGGAATGGGTC<br>GGAGACATCTACCCCGGC<br>TCCTCCATCTGCAACTAC<br>AACGAGAAGTTCAAGTCC<br>CGGTTCACCATCTCCGTG<br>GACAACTCCAAGTCCACC<br>GCCTACCTCCAGATGAAC<br>TCCCTGAGAGCCGAGGAC<br>ACCGCCGTGTACTACTGC<br>GCCAGAGAGGACGGCTAC<br>GACGCTTGGTTTGCTTAC<br>TGGGGCCAGGGCACCCTG<br>GTCACCGTGTCATCT<br>(Nucleotides 58 to<br>414 of SEQ ID NO:<br>298)<br>[SEQ ID NO: 303]<br>EVQLLESGGGLVQPGGSL<br>RLSCAASGYTFTTYWITW<br>VRQAPGKGLEWVGDIYPG<br>SSICNYNEKFKSRFTISV<br>DNSKSTAYLQMNSLRAED<br>TAVYYCAREDGYDAWFAY<br>WGQGTLVTVSS<br>[SEQ ID NO: 304] | GCATCACCAAGGGCCCA<br>TCGGTCTTCCCCCTGGCA<br>CCCTCCTCCAAGAGCACC<br>TCTGGGGCACAGGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGGA<br>CCGTCAGTCTTCCTCTTC<br>CCCCCAAAACCCAAGGAC<br>ACCCTCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT<br>AATGCCAAGACAAAGCCG<br>CGGGAGGAGCAGTACAAC<br>AGCACGTACCGTGTGGTC<br>AGCGTCCTCACCGTCCTG<br>CACCAGGACTGGCTGAAT<br>GGCAAGGAGTACAAGTGC<br>AAGGTCTCCAACAAAGCC<br>CTCCCAGCCCCCATCGAG<br>AAAACCATCTCCAAAGCC<br>AAAGGGCAGCCCCGAGAA<br>CCACAGGTGTACACCCTG<br>CCCCCATCCCGGATGAG<br>CTGACCAAGAACCAGGTC<br>AGCCTGACCTGCCTGGTC<br>AAAGGCTTCTATCCCAGC |

TABLE 1-continued

| | | |
|---|---|---|
| GTCCTGCAGGACTGCTGAAT<br>GGCCAAGGAGTACAAGTCGCAAGGTC<br>TCCAACAAAGCCCCTCCAGCCCCC<br>ATCGAGAAAACCATCTCCAAAGCC<br>AAAGGGCAGCCCCGAGAACCACAG<br>GTGTACACCCTGCCCCCATCCCGG<br>GATGAGCTGACCAAGAACCAGGTC<br>AGCCTGACCTGCCTGGTCAAAGGC<br>TTCTATCCCAGCGACATCGCCGTG<br>GAGTGGGAGAGCAATGGGCAGCCG<br>GAGAACAACTACAAGACCACGCCT<br>CCCGTGCTGGACTCCGACGGCTCC<br>TTCTTCTTATATTCAAAGCTCACC<br>GTGGACAAGAGCAGGTGGCAGCAG<br>GGGAACGTCTTCTCATGCTCCGTG<br>ATGCATGAGGCTCTGCACAACCAC<br>TACACGCAGAAGAGCCTCTCCCTG<br>TCTCCGGGAAATGA<br>Without leader [SEQ ID<br>NO: 299]:<br>GAAGTGCAGCTGCTGGAATCTGGC<br>GGCGGACTGGTGCAGCCTGGCGGC<br>TCTCTGAGACTGTCTTGTGCCGCC<br>TCCGGCTACACCTTCACCACCTAC<br>TGGATCCACTGGGTTCCAGAGGCT<br>CCCGGCCAAGGGACTGGAATGGGTC<br>GGAGACATCTACCCCGGCTCCTCC<br>ATCTGCAACTACAACGAGAAGTTC<br>AAGTCCCGGTTCACCATCTCCGTG<br>GACAACTCCAAGTCCACCGCCTAC<br>CTCCAGATGAACTCCCTGAGAGCC<br>GAGGACACCGCCGTGTACTACTGC<br>GCCAGAGAGGACGCGTACGACGCT<br>TGGTTTGCTTACTGGGGCCAGGGC<br>ACCCTGGTCACCGTGTCATCTGCA<br>TCCACCAAGGGCCCATCGGTCTTC<br>CCCCTGGCCACCCCTCCAAGAGC<br>ACCTCTGGGGGCACAGCGGCCTG<br>GGCTGCCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTA<br>CAGTCCTCAGGACTCTACTCCCTC<br>AGCAGCGTGGTGACCGTGCCCTCC<br>AGCAGCTTGGGCACCCAGACCTAC<br>ATCTGCAACGTGAATCACAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCCTGGGGGGACCG<br>TCAGTCTTCCTCTTCCCCCCAAAA<br>CCCAAGGACACCCTCATGATCTCC<br>CGGACCCCTGAGGTCACATGCGTG | YPSDIAVEWESNGQPENNYKTT<br>PPVLDSDGSFFLYSKLTVDKSR<br>WQQGNVFSCSVMHEALHNHYTQ<br>KSLSLSPGK | GACATCGCCGTGGAGTGG<br>GAGAGCAATGGGCAGCCG<br>GAGAACAACTACAAGACC<br>ACGCCTCCCGTGCTGGAC<br>TCCGACGGCTCCTTCTTC<br>TTATATTCAAAGCTCACC<br>GTGGACAAGAGCAGGTGG<br>CAGCAGGGAACGTCTTC<br>TCATGCTCCGTGATGCAT<br>GAGGCTCTGCACAACCAC<br>TACACGCAGAAGAGCCTC<br>TCCCTGTCTCCGGG<br>(Nucleotides 415<br>to 1401)<br>[SEQ ID NO: 305]<br>ASTKGPSVFPLAPSSKST<br>SGGTAALGCLVKDYFPEP<br>VTVSWNSGALTSGVHTFP<br>AVLQSSGLYSLSSVVTVP<br>SSSLGTQTYICNVNHKPS<br>NTKVDKKVEPKSCDKTHT<br>CPPCPAPELLGGPSVFLF<br>PPKPKDTLMISRTPEVTC<br>VVVDVSHEDPEVKFNWYV<br>DGVEVHNAKTKPREEQYN<br>STYRVVSVLTVLHQDWLN<br>GKEYKCKVSNKALPAPIE<br>KTISKAKGQPREPQVYTL<br>PPSRDELTKNQVSLTCLV<br>KGFYPSDIAVEWESNGQP<br>ENNYKTTPPVLDSDGSFF<br>LYSKLTVDKSRWQQGNVF<br>SCSVMHEALHNHYTQKSL<br>SLSPGK<br>[SEQ ID NO: 306] |

TABLE 1-continued

| | | | |
|---|---|---|---|
| | GTGTGGACGTGAGCCACGAAGAC<br>CCTGAGGTCAAGTTCAACTGGTAC<br>GTGACGGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCCTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | | |
| 7G6-<br>HCzu13 | With leader [SEQ ID NO:<br>307]:<br>ATGGGCTGGTCCTGCATCATCCTG<br>TTTCTGGTGGCCACCGCCACCGGC<br>GTGCACAGCGAAGTGCAGCTGCTG<br>GAATCTGGCGGCGGACTGGTCTG<br>CCTGCGGCTCTTCTGAGACTGTCT<br>TGTGCCGCCTCCGGCTACACCTTC<br>ACCACTTACTGGATCACCTGGGTC<br>CGACAGGCTCCCGGCAAGGGACTG<br>GAATGGGTGGAGCATTTACCCC<br>GGCTCCTCCATCTGCAACTACGCC<br>GACTCCGTCAAGGGCCGGTTCACC<br>ATCTCCGTGGACAACTCCAAGTCC<br>ACCGCTTACCTGCAGATGAACTCC<br>CTGAGAGCCGAGGACACCGCCGTG<br>TACTACTGCGCCAGAGAGGACGGC<br>TACGACGCTTGGTTTGCTTACTGG<br>GGCCAGGGCACCCTGGTCACCGTG<br>TCATCTGCATCCACCAAGGGCCCA<br>TCGGTTCTTCCCCTGGCACCCTCC<br>AAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC | With leader [SEQ ID<br>NO: 309]:<br>MGWSCIILFLVATATGVHSEVQ<br>LLESGGGLVQPGGSLRLSCAAS<br>GYTFTTYWITWVRQAPGKGLEW<br>VGDIYPGSSICNYADSVKGRFT<br>ISVDNSKSTAYLQMNSLRAEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br>Without leader [SEQ ID<br>NO: 310]:<br>EVQLLESGGGLVQPGGSLRLSC<br>AASGYTFTTYWITWVRQAPGKG | ATGGGCTG<br>GTCCTGCA<br>TCATCCTG<br>TTTCTGT<br>GGCCACCG<br>CCACCGGC<br>GTGCACAG<br>C<br>(Nucleotides<br>1 to 57 of<br>SEQ ID<br>NO: 307)<br>[SEQ ID<br>NO: 311] | GAAGTGCAGCTGCTGGAA<br>TCTGGCGGCGGACTGGTG<br>CAGCCTGGCGGCTCTCTG<br>AGACTGTCTTGTGCCGCC<br>TCCGGCTACACCTTCACC<br>ACCTACTGGATCACCTGG<br>GTCCGACAGGCTCCCGGC<br>AAGGGACTGGAATGGGTC<br>GGAGACATCTACCCCGGC<br>TCCTCCATCTGCAACTAC<br>GCCGACTCCGTCAAGGGC<br>CGGTTCACCATCTCCGTG<br>GACAACTCCAAGTCCACC<br>GCCTACCTGCAGATGAAC<br>TCCCTGAGAGCCGAGGAC<br>ACCGCCGTGTACTACTGC<br>GCCAGAGAGGACGGCTAC<br>GACGCTTGGTTTGCTTAC<br>TGGGGCCAGGGCACCCTG<br>GTCACCGTGTCATCT<br>(Nucleotides 58 to<br>414 of SEQ ID NO:<br>307) [SEQ ID NO:<br>312]<br>EVQLLESGGGLVQPGGSL<br>RLSCAASGYTFTTYWITW<br>VRQAPGKGLEWVGDIYPG<br>SSICNYADSVKGRFTISV<br>GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TCTCACAAAACTCACACA<br>TGCCCACCGTGCCCAGCA<br>CCTGAACTCCTGGGGGA<br>CCGTCAGTCTTCCTCTTC<br>CCCCCAAAACCCAAGGAC<br>ACCCTCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT |

TABLE 1-continued

| | | |
|---|---|---|
| GTGCCCCTGCAGCAGCTTGGGCACC CAGACCTACATCTGCAACGTGAAT CACAAGCCCAGCAACACCAAGGTG GACAAGAAAGTTGAGCCCAAATCT TGTACAAAACTCACACATGCCCA CCGTGCCCAGCACCTCCTG GGGGACCCTCAGTCTTCCTCTTC CCCCAAAACCAAGGACACCCTC ATGATCTCCCGGACCCCTGAGGTC ACATGCGTGGTGGTGGACGTGAGC CACGAAGACCCTGAGGTCAAGTTC AACTGGTACGTGGACGGCGTGGAG GTGCATAATGCCAAGACAAAGCCG CGGGAGGAGCAGTACAACAGCACG TACCGTGTGGTCAGCGTCCTCACC GTCCTGCACCAGGACTGGCTGAAT GGCAAGGAGTACAAGTGCAAGGTC TCCAACAAAGCCATCTCCAGCCCC ATCGAGAAAACCATCTCCAAAGCC AAAGGGCAGCCCCGAGAACCACAG GTGTACACCCTGCCCCCATCCCGG GATGAGCTGACCAAGAACCAGGTC AGCCTGACCTGCCTGGTCAAAGGC TTCTATCCCAGCGACATCGCCGTG GAGTGGGAGAGCAATGGGCAGCCG GAGAACAACTACAAGACCACGCCT CCCGTGCTGGACTCCGACGGCTCC TTCTTCCTCTATAGCAAGCTCACC GTGGACAAGAGCAGGTGGCAGCAG GGGAACGTCTTCTCATGCTCCGTG ATGCATGAGGCTCTGCACAACCAC TACACGCAGAAGAGCCTCTCCCTG TCTCCGGGAAATGA<br><br>Without leader [SEQ ID NO: 308]:<br><br>GAAGTGCAGCTGCTGTGGAATCTGGC GGCGGACTGGTGCAGCCTGGCGGC TCTCTGAGACTGTCTTGTGCCGCC TCCGGCTACACCTTCACCACCTAC TGGATCACCTGGGTCCGACAGGCT CCCGGCAAGGGACTGGAATGGGTC GGAGACATCTACCCGGCTCCTCC ATCTGCAACTACGCCGACTCCGTC AAGGGCCGGTTCACCATCTCCGTG GACAACTCCAAGTCAACCTCCCTG CTCCAGATGAACTCCCTGAGAGCC GAGGACACCGCCGTGTACTACTGC GCCAGAGAGGGCTACGACGCT TGGTTTGCTTACTGGGGCCAGGGC ACCCTGGTCACCGTGTCATCGCA TCCACCAAGGGCCCATCGGTCTTC CCCCTGGCACCCTCCTCCAAGAGC ACCTCTGGGGGCACAGCGGCCCTG | LEWVGDIYPGSSICNYADSVKG RFTISVDNSKSTAYLQMNSLRA EDTAVYYCAREDGYDAWFAYWG QGTLVTVSSASTKGPSVFPLAP SSKSTSGGTAALGCLVKDYFPE PVTVSWNSGALTSGVHTFPAVL QSSGLYSLSSVVTVPSSSLGTQ TYICNVNHKPSNTKVDKKVEPK SCDKTHTCPPCPAPELLGGPSV FLFPPKPKDTLMISRTPEVTCV VVDVSHEDPEVKFNWYVDGVEV HNAKTKPREEQYNSTYRVVSVL TVLHQDWLNGKEYKCKVSNKAL PAPIEKTISKAKGQPREPQVYT LPPSRDELTKNQVSLTCLVKGF YPSDIAVEWESNGQPENNYKTT PPVLDSDGSFFLYSKLTVDKSR WQQGNVFSCSVMHEALHNHYTQ KSLSLSPGK | AATGCCAAGACAAAGCCG CGGGAGGAGCAGTACAAC ACCACTACCTCTCCTC AGCCTCCTCACCGTCCTG CACCAGGACTGGCTGAAT GGCAAGGAGTACAAGTGC AAGGTCTCCAACAAAGCC CTCCCAGCCCCATCGAG AAAACCATCTCCAAAGCC AAAGGGCAGCCCCGAGAA CCACAGGTGTACACCCTG CCCCCATCCCGGGATGAG CTGACCAAGAACCAGGTC AGCCTGACCTGCCTGGTC AAAGGCTTCTATCCCAGC GACATCGCCGTGGAGTGG GAGAGCAATGGGCAGCCG GAGAACAACTACAAGACC ACGCCTCCCGTGCTGGAC TCCGACGGCTCCTTCTTC TTATATTCAAAGCTCACC GTGGACAAGAGCAGGTGG CAGCAGGGAACGTCTTTC TCATGCTCCGTGATGCAT GAGGCTCTGCACAACCAC TACACGCAGAAGAGCCTC TCCCTGTCTCCGGGG<br><br>(Nucleotides 415 to 1401 of SEQ ID NO: 307)<br><br>[SEQ ID NO: 314] ASTKGPSVFPLAPSSKST SGGTAALGCLVKDYFPEP VTVSWNSGALTSGVHTFP AVLQSSGLYSLSSVVTVP SSSLGTQTYICNVNHKPS NTKVDKKVEPKSCDKTHT CPPCPAPELLGGPSVFLF PPKPKDTLMISRTPEVTC VVVDVSHEDPEVKFNWYV DGVEVHNAKTKPREEQYN STYRVVSVLTVLHQDWLN GKEYKCKVSNKALPAPIE KTISKAKGQPREPQVYTL PPSRDELTKNQVSLTCLV KGFYPSDIAVEWESNGQP ENNYKTTPPVLDSDGSFF LYSKLTVDKSRWQQGNVF SCSVMHEALHNHYTQKSL SLSPGK<br><br>[SEQ ID NO: 315] |
| DNSKSTAYLQMNSLRAED TAVYYCAREDGYDAWFAY WGQGTLVTVSS [SEQ ID NO: 313] | | |

TABLE 1-continued

| | | | |
|---|---|---|---|
| | GGCTGCCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTA<br>CAGTCCTCAGGACTCTACTCCCTC<br>AGCAGCGTGGTGACCGTGCCCTCC<br>AGCAGCTTGGGCACCCAGACCTAC<br>AICTGCAACGTGAATCACAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCCTGGGGGGACCG<br>TCAGTCTTCCTCTTCCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGGGAACAAC<br>TACAAGACCACGCCTCCCGTGCTG<br>GACTCCGACGGCTCCTTCTTCTTA<br>TATTCAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | | |
| 7G6-<br>HCzu14 | With leader [SEQ ID NO: 316]:<br><u>ATGGGCTGGTCCTGCATCATCCTG</u><br><u>TTTCTGGTGGCCACCGCCACCGGC</u><br>GTGCACAGCGAAGTGCAGCTGGTG<br>GAATCTGGCGGCGGACTGGTGCAG<br>CCTGGCGGCTCTCTGAGACTGTCT<br>TGTGCCGCCAGCGGCTACACCTTC<br>ACCACTTACTGGATCAACTGGGTC<br>CGACAGGCTCCCGGCAAGGGACTG<br>GAATGGGTCGGAGACATCTACCCC<br>GGCTCCTCATCTGCAACTACGCC<br>GACAAGTTCAAGGGCCGGGTTCACC<br>GACAAGTTCAAGGGCCGGGTTCACC | With leader [SEQ ID<br>NO: 317]:<br>MGWSCIILFLVATATGVHSEVQ<br>LLESGGGLVQPGGSLRLSCAAS<br>GYTFTTYWINWVRQAPGKGLEW<br>VGDIYPGSSICNYADKFKGRFT<br>ISVDNSKSTAYLQMNSLRAEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD | ATGGGCTG<br>GTCCTGCA<br>TCATCCTG<br>TTTCTGGT<br>GGCCACCG<br>CCACCGGC<br>TGTGCACAG<br>C (Nucleotides<br>1<br>to 57 of<br>SEQ ID<br>NO: 316) | GAAGTGCAGCTGCTGGAA<br>TCTGGCGGCGGACTGGTG<br>CAGCCTGGCGGCTCTCTG<br>AGACTGTCTTGTGCCGCC<br>TCCGGCTACACCTTCACC<br>ACCTACTGGATCAACTGG<br>GTCCGACAGGCTCCCGGC<br>AAGGGACTGGAATGGGTC<br>GGAGACATCTACCCCGGC<br>TCCTCCATCTGCAACTAC<br>GCCGACAAGTTCAAGGGC<br>CGGTTCACCATCTCCGTG<br>GACAACTCCAAGTCCACC | GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC |

TABLE 1-continued

| | | |
|---|---|---|
| ATCTCCGTGGACAACTCCAAGTCC | KTHTCPPCPAPELLGGPSVFLF | GCCTACCTCCAGATGAAC |
| ACCGCCTACCTGCAGATGAACTCC | PPKPKDTLMISRTPEVTCVVVD | TCCCTGAGAGCCGAGGAC |
| CTGAGAGCCGAGGACACCGCCGTG | VSHEDPEVKFNWYVDGVEVHNA | ACCGCCGTGTACTACTGC |
| TACTACTGCGCCAGAGAGGACGGC | KTKPREEQYNSTYRVVSVLTVL | GCCAGAGAGGACGGCTAC |
| TACGACGTTGGTTTGCTTACTGG | HQDWLNGKEYKCKVSNKALPAP | GACGCTTGGTTTGCTTAC |
| GGCCAGGGCACCCTGGTCACCGTG | IEKTISKAKGQPREPQVVTLPP | TGGGGCCAGGGCACCCTG |
| TCATCTGATCACCAAGGGCCA | SRDELTKNQVSLTCLVKGFYPS | CCTGAACTCCTGGGGGA |
| TCCGTCTTCCCCCTGGCACCCTCC | DIAVEWESNGQPENNYKTTPPV | CCGTCAGTCTTCCTTC |
| TCCAAGAGCACCTCTGGGGCACA | LDSDGSFFLYSKLTVDKSRWQQ | CCCCAAAACCCAAGGAC |
| GCCGCCCTGGGCTGCCTGGTCAAG | GNVFSCSVMHEALHNHYTQKSL | ACCCTCATGATCTCCCGG |
| GACTACTTCCCCGAACCGGTGACG | SLSPGK | ACCCCTGAGGTCACATGC |
| GTGTCGTGGAACTCAGGCGCCCTG | Without leader [SEQ ID | GTGTGGTGGACGTGAGC |
| ACCAGCGGCGTGCACACCTTCCCG | NO: 318]: | CACGAAGACCCTGAGGTC |
| GCTGTCCTACAGTCCTCAGGACTC | EVQLLESGGGLVQPGGSLRLSC | AAGTTCAACTGGTACGTG |
| TACTCCCGCAGCGTGTGACC | AASGYTFTYWITWVRQAPGKG | GACGGCGTGGAGGTGCAT |
| GTGCCCCTCCAGCAGCTTGGGCAC | LEWVGDIYPGSSICNYADKFKG | AATGCCAAGACAAAGCCG |
| CAGACCTACATCTGCAACGTGAAT | RFTISVDNSKSTAYLQMNSLRA | CGGGAGGAGCAGTACAAC |
| CACAAGCCCAGCAACACCAAGGTG | EDTAVYYCAREDGYDAWFAYWG | AGCACGTACCGTGTGGTC |
| GACAAGAAGTTGAGCCCAAATCT | QGTLVTVSSASTKGPSVFPLAP | AGCGTCCTCACCGTCCTG |
| TGTCGACAAAACTCACACATGCCA | SSKSTSGGTAALGCLVKDYFPE | CACCAGGACTGGCTGAAT |
| CCGTGCCCAGCACCTGAACTCCTG | PVTVSWNSGALTSGVHTFPAVL | GGCAAGGAGTACAAGTGC |
| GGGGACCGTCAGTCTTCCTCTTC | QSSGLYSLSSVVTVPSSSLGTQ | AAGGTCTCCAACAAAGCC |
| CCCCCAAAACCCAAGGACACCCTC | TYICNVNHKPSNTKVDKKVEPK | CTCCCACCCCCATCGAG |
| ATGATCTCCCGGACCCCTGAGGTC | SCDKTHTCPPCPAPELLGGPSV | AAAACCATCTCCAAAGCC |
| ACATGCGTGGTGGTGGACGTGAGC | FLFPPKPKDTLMISRTPEVTCV | AAAGGGCAGCCCCGAGAA |
| GAAGACCCTGAGGTCAAGTTC | VVDVSHEDPEVKFNWYVDGVEV | CCACAGGTGTACACCCTG |
| AACTGGTACGTGGACGGCGTGGAG | HNAKTKPREEQYNSTYRVVSVL | CCCCCATCCCGGGATGAG |
| GTGCATAATGCCAAGACAAAGCCG | TVLHQDWLNGKEYKCKVSNKAL | CTGACCAAGAACCAGGTC |
| CGGGAGGAGCAGTACAACAGCACG | PAPIEKTISKAKGQPREPQVYT | AGCCTGACCTGCCTGGTC |
| TACCGTGTGGTCAGCGTCCTCACC | LPPSRDELTKNQVSLTCLVKGF | AAAGGCTTCTATCCCAGC |
| GTCCTGCACCAGGACTGGCTGAAT | YPSDIAVEWESNGQPENNYKTT | GACATCGCCGTGGAGTGG |
| GGCAAGGAGTACAAGTGCAAGGTC | PPVLDSDGSFFLYSKLTVDKSR | GAGAGCAATGGGCAGCCG |
| TCCAACAAAGCCCTCCCAGCCCC | WQQGNVFSCSVMHEALHNHYTQ | GAGAACAACTACAAGACC |
| ATCGAGAAAACCATCTCCAAAGCC | KSLSLSPGK | ACGCCTCCCGTGCTGGAC |
| AAAGGGCAGCCCCGAGAACCACAG | | TCCGACGGCTCCTTCTTC |
| GTGTACACCCTGCCCCCATCCCGG | | TTATATTCAAAGCTCACC |
| GATGAGCTGACCAAGAACCAGGTC | | GTGGACAAGAGCAGGTGG |
| AGCCTGACCTGCCTGGTCAAAGGC | | CAGCAGGGGAACGTCTTC |
| TTCTATCCCAGCGACATCGCCGTG | | TCATGCTCCGTGATGCAT |
| GAGTGGGAGAGCAATGGGCAGCCG | | GAGGCTCTGCACAACCAC |
| GAGAACAACTACAAGACCACGCCT | | TACACGCAGAAGAGCCTC |
| CCCGTGCTGGACTCCGACGGCTCC | | TCCCTGTCTCCGGG |
| TTCTTCTATATTCAAAGCTCACC | | (Nucleotides 415 |
| GTGGACAAGAGCAGGTGGCAGCAG | | to 1401 of SEQ ID |
| GGGAACGTCTTCTCATGCTCCGTG | | NO: 316) |
| ATGCATGAGGCTCTGCACAACCAC | | |
| TACACGCAGAAGAGCCTCTCCCTG | | [SEQ ID NO: 322] |
| TCTCCGGGAAATGA | | ASTKGPSVFPLAPSSKST |
| Without leader [SEQ ID | | SGGTAALGCLVKDYFPEP |
| NO: 1134]: | | VTVSWNSGALTSGVHTFP |
| GAAGTGCAGCTGCTGGAATCTGGC | | AVLQSSGLYSLSSVVTVP |
| GGCGGACTGGTGCAGCCTGGCGGC | | SSSLGTQTYICNVNHKPS |
| TCTCTGAGACTGTCTTGTGCCGCC | | NTKVDKKVEPKSCDKTHT |
| | | CPPCPAPELLGGPSVFLF |

TABLE 1-continued

```
TCCGGCTACACCTTCACCACCTAC    PPKPKDTLMISRTPEVTC
TGGATCACCTGGGTCCGACAGGCT    VVVDVSHEDPEVKFNWYV
CCCGGCAAGGGACTGGAATGGGTC    DGVEVHNAKTKPREEQYN
GGAGACATCTACCCCGGCTCCTCC    STYRVVSVLTVLHQDWLN
ATCTGCAACTACGCCGACAAGTTC    GKEYKCKVSNKALPAPIE
AAGGGCCGGTTCACCATCTCCGTG    KTISKAKGQPREPQVYTL
GACAACTCCAAGTCAACCGCCTAC    PPSRDELTKNQVSLTCLV
CTCCAGATGAACTCCCTGAGAGCC    KGFYPSDIAVEWESNGQP
GAGGACACCGCCGTGTACTACTGC    ENNYKTTPPVLDSDGSFF
GCCAGAGAGGACGGCTACGAGCT     LYSKLTVDKSRWQQGNVF
TGGTTTGCTTACTGGGGCCAGGGC    SCSVMHEALHNHYTQKSL
ACCCTGGTCACCGTCTCATCTGCA    SLSPGK
TCCACCAAGGGCCCATCGGTCTTC    [SEQ ID NO: 323]
CCCCTGGCACCCTCCTCCAAGAGC
ACCTCTGGGGCACAGCGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCCTGGGGGACCG
TCAGTCTTCCTCTTCCCCCCAAAA
CCCAAGGACACCCTCATGATCTCC
CGGACCCCCTGAGGTCACATGCGTG
GTGGTGGACGTGAGCCACGAAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC
CAGGACTGGCTGAATGGCAAGGAG
TACAAGTGCAAGGTCTCCAACAAA
GCCCTCCCAGCCCCCATCGAGAAA
ACCATCTCCAAAGCCAAAGGGCAG
CCCCGAGAACCACAGGTGTACACC
CTGCCCCCATCCCGGGATGAGCTG
ACCAAGAACCAGGTCAGCCTGACC
TGCCTGGTCAAAGGCTTCTATCCC
AGCGACATCGCCGTGGAGTGGGAG
AGCAATGGGCAGCCGGAGAACAAC
TACAAGACCACGCCTCCCGTGCTG
GACTCCGACGGCTCCTTCTTCTTA
TATTCAAAGCTCACCGTGGACAAG
AGCAGGTGGCAGCAGGGGAACGTC
TTCTCATGCTCCGTGATGCATGAG
```

TABLE 1-continued

| | | | | |
|---|---|---|---|---|
| | | GCTCTGCACAACCACTACACGCAG<br>AAGAGCCTCTCCCTGTCTCCCGGG<br>AAATGA | | |
| 7G6-<br>HCzu15 | With leader [SEQ ID NO:<br>324]:<br>ATGGGCTGTCCTGTCATCATCCTG<br>TTTCTGTTGGCCACCGCCACCGGC<br>GTGCACAGCGAAGTGCAGCTGCTG<br>GAATCTGGCGGCGGACTGGTGCAG<br>CCTGGCGGTCTCTGAGACTGTCT<br>TGTGCGCCTCCGGCTACACCTTC<br>ACCACTTACTGGATCACCTGGGTC<br>CGACAGGCTCCCGGCCAAGGACTG<br>GAATGGTCGAGACATTACCCC<br>GGCTCCTCCATCTGCAACTACAAC<br>GAGAAGTTCAAGTCCGGTTCACC<br>ATCTCCGTGGACAACTCCCAAGAAC<br>ACCGCTACCTGCAGATGAACTCC<br>CTGAGAGCCGAGGACACCGCCGTG<br>TACTACTGCGCCAGAGAGGACGGC<br>TACGACGTTGGTTTGCTTACTGG<br>GGCCAGGGCACCCTGGTCACCGTG<br>TCATCTGCATCCACCAAGGGCCCA<br>TCGGTCTTCCCCCTGGCACCCTCC<br>TCCAAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC<br>GTGCCCCTCCAGCAGCTTGGGCACC<br>CAGACCTACATCTGCAACGTGAAT<br>CACAAGCCCAGCAACACCAAGGTG<br>GACAAGAAAGTTGAGCCCAAATCT<br>TGTGACAAAACTCACACATGCCCA<br>CCGTGCCCAGCACCTGAACTCCTG<br>GGGGGACCGTCAGTCTTCCTCTTC<br>CCCCCAAAACCCAAGGACACCCTC<br>ATGATCTCCCGGACCCCTGAGGTC<br>ACATGCGTGGTGGACGTGAGC<br>CACGAAGACCCTGAGGTCAAGTTC<br>AACTGGTACGTGGACGGCGTGGAG<br>GTGCATAATGCCAAGACAAAGCCG<br>CGGGAGGAGCAGTACAACAGCACG<br>TACCGTGTGGTCAGCGTCCTCACC<br>GTCCTGCACCAGGACTGGCTGAAT<br>GGCAAGGAGTACAAGTGCAAGGTC<br>TCCAACAAAGCCCTCCCAGCCCCC<br>ATCGAGAAAACCATCTCCAAAGCC<br>AAAGGGCAGCCCCGAGAACCACAG<br>GTGTACACCCTGCCCCCATCCCG | With leader [SEQ ID<br>NO: 326]:<br>MGWSCIILFLVATATGVHSEVQ<br>LLESGGGLVQPGGSLRLSCAAS<br>GYTFTTYWITWVRQAPGKGLEW<br>VGDIYPGSSICNYNEKFKSRFT<br>ISVDNSKNTAYLQMNSLRAEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br>Without leader [SEQ ID<br>NO: 327]:<br>EVQLLESGGGLVQPGGSLRLSC<br>AASGYTFTTYWITWVRQAPGKG<br>LEWVGDIYPGSSICNYNEKFKS<br>RFTISVDNSKNTAYLQMNSLRA<br>EDTAVYYCAREDGYDAWFAYWG<br>QGTLVTVSSASTKGPSVFPLAP<br>SSKSTSGGTAALGCLVKDYFPE<br>PVTVSWNSGALTSGVHTFPAVL<br>QSSGLYSLSSVVTVPSSSLGTQ<br>TYICNVNHKPSNTKVDKKVEPK<br>SCDKTHTCPPCPAPELLGGPSV<br>FLFPPKPKDTLMISRTPEVTCV<br>VVDVSHEDPEVKFNWYVDGVEV<br>HNAKTKPREEQYNSTYRVVSVL<br>TVLHQDWLNGKEYKCKVSNKAL<br>PAPIEKTISKAKGQPREPQVYT<br>LPPSRDELTKNQVSLTCLVKGF<br>YPSDIAVEWESNGQPENNYKTT<br>PPVLDSDGSFFLYSKLTVDKSR<br>WQQGNVFSCSVMHEALHNHYTQ<br>KSLSLSPGK | GAAGTGCAGCTGCTGGAA<br>TCTGGCGGCGGACTGGTG<br>CAGCCTGGCGGTCTCTG<br>AGACTGTCTTGTGCCGCC<br>TCCGGCTACACCTTCACC<br>ACCTACTGGATCACCTGG<br>GTCCGACAGGCTCCCGGC<br>AAGGGACTGGAATGGGTC<br>GGAGACATTACCCCGGC<br>TCCTCCATCTGCAACTAC<br>AACGAGAAGTTCAAGTCC<br>CGGTTCACCATCTCCGTG<br>GACAACTCCAAGAACACC<br>GCCTACCTGCAGATGAAC<br>TCCCTGAGAGCCGAGGAC<br>ACCGCCGTGTACTACTGC<br>GCCAGAGAGGACGGCTAC<br>GACGTTGGTTTGCTTAC<br>TGGGGCCAGGGCACCCTG<br>GTCACCGTGTCATCT<br>GCATCCACCAAGGGCCCA<br>(Nucleotides 58 to<br>414 of SEQ ID NO:<br>324)<br>[SEQ ID NO: 329]<br>EVQLLESGGGLVQPGGSL<br>RLSCAASGYTFTTYWITW<br>VRQAPGKGLEWVGDIYPG<br>SSICNYNEKFKSRFTISV<br>DNSKNTAYLQMNSLRAED<br>TAVYYCAREDGYDAWFAY<br>WGQGTLVTVSS[SEQ<br>ID NO: 330] | ATGGGCTGTCCTGCATC<br>ATCCTGTTTCTGTTGGCC<br>ACCGCCACCGGCGTGCAC<br>AGCGAAGTGCAGCTGCTG<br>GAATCTGGCGGCGGACTG<br>GTGCAGCCTGGCGGTCT<br>CTGAGACTGTCTTGTGCC<br>GCCTCCGGCTACACCTTC<br>ACCACCTACTGGATCACC<br>TGGGTCCGACAGGCTCCC<br>GGCAAGGGACTGGAATGG<br>GTCGGAGACATTACCCC<br>GGCTCCTCCATCTGCAAC<br>TACAACGAGAAGTTCAAG<br>TCCCGGTTCACCATCTCC<br>GTGGACAACTCCAAGAAC<br>ACCGCCTACCTGCAGATG<br>AACTCCCTGAGAGCCGAG<br>GACACCGCCGTGTACTAC<br>TGCGCCAGAGAGGACGGC<br>TACGACGTTGGTTTGCT<br>TACTGGGGCCAGGGCACC<br>CTGGTCACCGTGTCATCT<br>GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGGA<br>CCGTCAGTCTTCCTCTTC<br>CCCCCAAAACCCAAGGAC<br>ACCCTCATGATCTCCCGG<br>ACCCCTGAGGTCACATGC<br>GTGGTGGACGTGAGC<br>CACGAAGACCCTGAGGTC |

TABLE 1-continued

GATGAGCTGACCAAGAACCAGGTC
AGCCTGACCTGCCTGGTCAAAGGC
TTCTATCCCAGCGACATCGCCGTG
GAGTGGGAGAGCAATGGGCAGCCG
GAGAACAACTACAAGACCACGCCT
CCCGTGCTGGACTCCGACGGCTCC
TTCTTCTTATATTCAAAGCTCACC
GTGGACAAGAGCAGGTGGCAGCAG
GGGAACGTCTTCTCATGCTCCGTG
ATGCATGAGGCTCTGCACAACCAC
TACACGCAGAAGAGCCTCTCCCTG
TCTCCGGGAAATGA
Without leader [SEQ ID
NO: 325]:
GAAGTGCAGCTGCTGGAATCTGGC
GGCGGACTGGTGCAGCCTGGCGGC
TCTCTGAGACTGTCTTGTGCCGCC
TCCGGCTACACCTTCACCACCTAC
TGGATCACCTGGGTCCGACAGGCT
CCCGGCAAGGGACTGGAATGGGTC
GGAGACATCTACCCGGCTCCTCC
ATCTGCAACTACAACGAGAAGTTC
AAGTCCCGTTCACCATCTCCGTG
GACAACTCCAAGAACACCCCTAC
CTCCAGATGAACTCCCTGAGAGCC
GAGGACACCGCCGTGTACTACTGC
GCCAGAGAGACCGGCTACGACGCT
TGGTTTGCTTACTGGGGCCAGGGC
ACCCTGGTCACCGTCATCTGCA
TCCACCAAGGGCCCATCGGTCTTC
CCCTGGCACCCTCCTCCAAGAGC
ACCTCTGGGGGCACAGCGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCTGGGGGGACCG
TCAGTCTTCCTCTTCCCCCCAAAA
CCCAAGGACACCCTCATGATCTCC
CGGACCCCTGAGGTCACATGCGTG
GTGGTGGACGTGAGCCACGAAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC AAGTTCAACTGGTACGTG
GACGGCGTGGAGGTGCAT
AATGCCAAGACAAAGCCG
CGGGAGGAGCAGTACAAC
AGCACGTACCGTGTGGTC
AGCGTCCTCACCGTCCTG
CACCAGGACTGGCTGAAT
GGCAAGGAGTACAAGTGC
AAGGTCTCCAACAAAGCC
CTCCCAGCCCCCATCGAG
AAAACCATCTCCAAAGCC
AAAGGGCAGCCCCGAGAA
CCACAGGTGTACACCCTG
CCCCCATCCCGGGATGAG
CTGACCAAGAACCAGGTC
AGCCTGACCTGCCTGGTC
AAAGGCTTCTATCCCAGC
GACATCGCCGTGGAGTGG
GAGAGCAATGGGCAGCCG
GAGAACAACTACAAGACC
ACGCCTCCCGTGCTGGAC
TCCGACGGCTCCTTCTTC
TTATATTCAAAGCTCACC
GTGGACAAGAGCAGGTGG
CAGCAGGGGAACGTCTTC
TCATGCTCCGTGATGCAT
GAGGCTCTGCACAACCAC
TACACGCAGAAGAGCCTC
TCCCTGTCTCCGGG
(Nucleotides 415
to 1401 of SEQ ID
NO: 324)
[SEQ ID NO: 331]
ASTKGPSVFPLAPSSKST
SGGTAALGCLVKDYFPEP
VTVSWNSGALTSGVHTFP
AVLQSSGLYSLSSVVTVP
SSSLGTQTYICNVNHKPS
NTKVDKKVEPKSCDKTHT
CPPCPAPELLGGPSVFLF
PPKPKDTLMISRTPEVTC
VVVDVSHEDPEVKFNWYV
DGVEVHNAKTKPREEQYN
STYRVVSVLTVLHQDWLN
GKEYKCKVSNKALPAPIE
KTISKAKGQPREPQVYTL
PPSRDELTKNQVSLTCLV
KGFYPSDIAVEWESNGQP
ENNYKTTPPVLDSDGSFF
LYSKLTVDKSRWQQGNVF
SCSVMHEALHNHYTQKSL
SLSPGK
[SEQ ID NO: 332]

TABLE 1-continued

| | | |
|---|---|---|
| | CAGGACTGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCTTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | | |
| 7G6-<br>HCzu16 | With leader [SEQ ID NO: 333]:<br>ATGGGCTGGTCCTGCATCATCCTG<br>TTTCTGGTGGCCACCGCCACCGGC<br>GTGCACAGCGAAGTGCAGCTGCTG<br>GAATCTGGCGGCGGACTGGTGCAG<br>CCTGGCGGCTCTCTGAGACTGTCT<br>TGTGCCGCCTCCGGCTACACCTTC<br>ACCACTTACTGGATCACCTGGGTC<br>CGACAGGCTCCCGGCAAGGACTG<br>GAATGGGTTCCATCGACATCTACCCC<br>GGCTCCATCTGCAACTACAAC<br>GAGAAGTTCAAGTCCCGGTTCACC<br>ATCTCCGTGGACAACTCCAAGAAC<br>ACCGCCTACCTCCAGATGAACTCC<br>CTGAGAGCCGAGGACACCGCCGTG<br>TACTACTGCGCCAGAGAGGACGGC<br>TACGACGCTTGGTTTGCTTACTGG<br>GGCCAGGGCACCCTGGTCACCGTG<br>TCATCTGCTTCCACCAAGGGCCCA<br>TCCGTCTTCCCCCTGGCCCCCTCC<br>TCCAAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC<br>TACTCCCTCAGCAGCGTGGTGACC<br>GTGCCCTCCAGCAGCTTGGGCACC<br>CAGACCTACATCTGCAACGTGAAT<br>CACAAGCCCAGCAACACCAAGGTG<br>GACAAGAAAGTTGAGCCCAAATCT<br>TGTGACAAAACTCACACATGCCCA<br>CCGTGCCCAGCACCTGAACTCCTG | With leader [SEQ ID NO: 335]:<br>MGWSCIILFLVATATGVHSEVQ<br>LLESGGGLVQPGGSLRLSCAAS<br>GYTFTTYWITWVRQAPGKGLEW<br>VSDIYPGSSICNYNEKFKSRFT<br>ISVDNSKNTAYLQMNSLRAEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br><br>Without leader [SEQ ID NO: 336]:<br>EVQLLESGGGLVQPGGSLRLSC<br>AASGYTFTTYWITWVRQAPGKG<br>LEWVSDIYPGSSICNYNEKFKS<br>RFTISVDNSKNTAYLQMNSLRA<br>EDTAVYYCAREDGYDAWFAYWG<br>QGTLVTVSSASTKGPSVFPLAP<br>SSKSTSGGTAALGCLVKDYFPE<br>PVTVSWNSGALTSGVHTFPAVL | ATGGGCTG<br>GTCCTGCA<br>TCATCCTG<br>TTTCTGGT<br>GGCCACCG<br>CCACCGGC<br>GTGCACAG<br>C<br>(Nucleotides<br>1<br>to 57 of<br>SEQ ID<br>NO: 333)<br>[SEQ ID<br>NO: 337]<br><br>(Nucleotides 58 to<br>414 of SEQ ID NO:<br>333)<br>[SEQ ID NO: 338] | GAAGTGCAGCTGCTGGAA<br>TCTGGCGGCGGACTGGTG<br>CAGCCTGGCGGCTCTCTG<br>AGACTGTCTTGTGCCGCC<br>TCCGGCTACACCTTCACC<br>ACTTACTGGATCACCTGG<br>GTCCGACAGGCTCCCGGC<br>AAGGGACTGGAATGGGTC<br>TCCGACATCTACCCCGGC<br>TCCTCCATCTGCAACTAC<br>AACGAGAAGTTCAAGTCC<br>CGGTTCACCATCTCCGTG<br>GACAACTCCAAGAACACC<br>GCCTACCTCCAGATGAAC<br>TCCCTGAGAGCCGAGGAC<br>ACCGCCGTGTACTACTGC<br>GCCAGAGAGGACGGCTAC<br>GACGCTTGGTTTGCTTAC<br>TGGGGCCAGGGCACCCTG<br>GTCACCGTGTCCAGCA<br>CCTGAACTCCTGCCCAGCA<br>CCGTCAGTCTTCTCTTC<br>CCCCAAAACCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT<br>AATGCCAAGACAAAGCCG<br>CGGGAGGAGCAGTACAAC<br>AGCACGTACCGTGTGGTC<br>AGCGTCCTCACCGTCCTG<br>CACCAGGACTGGCTGAAT<br>GGCAAGGAGTACAAGTGC<br>GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGGGGGGA<br>CCGTCAGTCTTCCTCTTC<br>CCCCCAAAACCATGATCTCCCGG<br>ACCCCTGAGGTCACATGC<br>GTGGTGGTGGACGTGAGC<br>CACGAAGACCCTGAGGTC<br>AAGTTCAACTGGTACGTG<br>GACGGCGTGGAGGTGCAT<br>AATGCCAAGACAAAGCCG<br>CGGGAGGAGCAGTACAAC<br>AGCACGTACCGTGTGGTC<br>AGCGTCCTCACCGTCCTG<br>CACCAGGACTGGCTGAAT<br>GGCAAGGAGTACAAGTGC |

[SEQ ID NO: 339]

TABLE 1-continued

| | | |
|---|---|---|
| GGGGGACCGTCAGTCTTCCTCTTC | QSSGLYSLSSVVTVPSSSLGTQ | AAGGTCTCCAACAAAGCC |
| CCCCAAAACCCAAGGACCACCCTC | TYICNVNHKPSNTKVDKKVEPK | CTCCCAGCCCCCATCGAG |
| ATGATCTCCGGACCCCCTGAGGTC | SCDKTHTCPPCPAPELLGGPSV | AAAACCATCTCAAAGCC |
| ACATGCGTGGTGGTGGACGTGAGC | FLFPPKPKDTLMISRTPEVTCV | AAAGGGCAGCCCCGAGAA |
| CACGAAGACCCTGAGGTCAAGTTC | VVDVSHEDPEVKFNWYDGVEV | CCCAGGTGTACACCCTG |
| AACTGGTACGTGGACGGCGTGGAG | HNAKTKPREEQYNSTYRVVSVL | CCCCCATCCGGGATGAG |
| GTGCATAATGCCAAGACAAAGCCG | TVLHQDWLNGKEYKCKVSNKAL | CTGACCAAGAACCAGGTC |
| CGGGAGGAGCAGTACAACAGCACG | PAPIEKTISKAKGQPREPQVYT | AGCCTGACCTGCCTGGTC |
| TACCGTGTGGTCAGCGTCCTCACC | LPPSRDELTKNQVSLTCLVKGF | AAAGGCTTCTATCCCAGC |
| GTCCTGCACCAGGACTGGCTGAAT | YPSDIAVEWESNGQPENNYKTT | GACATCGCCGTGGAGTGG |
| GGCAAGGAGTACAAGTGCAAGGTC | PPVLDSDGSFFLYSKLTVDKSR | GAGAGCAATGGGCAGCCG |
| TCCAACAAAGCCCTCCCAGCCCCC | WQQGNVFSCSVMHEALHNHYTQ | GAGAACAACTACAAGACC |
| ATCGAGAAACCATCTCAAAGCC | KSLSLSPGK | ACGCCTCCCGTGCTGGAC |
| AAAGGGCAGCCCCGAGAACCACAG | | TCCGACGGCTCCTTCTTC |
| GTGTACACCCTGCCCCCATCCCGG | | TTATATTCAAAGCTCACC |
| GATGAGCTGACCAAGAACCAGGTC | | GTGGACAAGAGCAGGTGG |
| AGCCTGACCTGCCTGGTCAAAGGC | | CAGCAGGGGAACGTCTTC |
| TTCTATCCCAGCGACATCGCCGTG | | TCATGCTCCGTGATGCAT |
| GAGTGGGAGAGCAATGGGCAGCCG | | GAGGCTCTGCACAACCAC |
| GAGAACAACTACAAGACCACGCCT | | TACACGCAGAAGAGCCTC |
| CCCGTGCTGGACTCCGACGGCTCC | | TCCCTGTCTCCGGGAAA |
| TTCTTCTTATATTCAAAGCTCACC | | TGA |
| GTGGACAAGAGCAGGTGGCAGCAG | | (Nucleotides 415 |
| GGGAACGTCTTCTCATGCTCCGTG | | to 1401 of SEQ ID |
| ATGCATGAGGCTCTGCACAACCAC | | NO: 333) |
| TACACGCAGAAGAGCCTCTCCCTG | | [SEQ ID NO: 340] |
| TCTCCGGGAAATGA | | ASTKGPSVFPLAPSSKST |
| Without leader [SEQ ID | | SGGTAALGCLVKDYFPEP |
| NO: 334]: | | VTVSWNSGALTSGVHTFP |
| GAAGTGCAGCTGCTGGAATCTGGC | | AVLQSSGLYSLSSVVTVP |
| GGCGGACTGGTGCAGCCTGGCGGC | | SSSLGTQTYICNVNHKPS |
| TCTCTGAGACTGTCTTGTGCCGCC | | NTKVDKKVEPKSCDKTHT |
| TCCGGCTACACCTTCACCACCTAC | | CPPCPAPELLGGPSVFLF |
| TGGATCACCTGGGTCCGACAGGCT | | PPKPKDTLMISRTPEVTC |
| CCCGGAAGGGACTGGAATGGGTC | | VVVDVSHEDPEVKFNWYV |
| TCCGACATCTACCCCGGCTCCTCC | | DGVEVHNAKTKPREEQYN |
| ATCTGCAACTACAACGAGAAGTTC | | STYRVVSVLTVLHQDWLN |
| AAGTCCCGGTTCACCATCTCCGTG | | GKEYKCKVSNKALPAPIE |
| GACAACTCCAAGAACACCCCCTAC | | KTISKAKGQPREPQVYTL |
| CTCCAGATGAACTCCCTGAGAGCC | | PPSRDELTKNQVSLTCLV |
| GAGGACACCGCCGTGTACTACTGC | | KGFYPSDIAVEWESNGQP |
| GCCAGAGAGGACGGCTACGACGCT | | ENNYKTTPPVLDSDGSFF |
| TGGTTTGCTTACTGGGGCCAGGGC | | LYSKLTVDKSRWQQGNVF |
| ACCCTGGTCACCGTGTCATCTGCA | | SCSVMHEALHNHYTQKSL |
| TCCACCAAGGGCCCATCCGTCTTC | | SLSPGK |
| CCCCTGGCACCCTCCTCCAAGAGC | | [SEQ ID NO: 341] |
| ACCTCTGGGGGCACAGCGGCCCTG | | |
| GGCTGCCTGGTCAAGGACTACTTC | | |
| CCCGAACCGGTGACGGTGTCGTGG | | |
| AACTCAGGCGCCCTGACCAGCGGC | | |
| GTGCACACCTTCCCGGCTGTCCTA | | |
| CAGTCCTCAGGACTCTACTCCCTC | | |
| AGCAGCGTGGTGACCGTGCCCTCC | | |

TABLE 1-continued

| | | | |
|---|---|---|---|
| | AGCAGCTTGGGCACCCAGACCTAC<br>AATGCAACGTGAATCACAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCCTGGGGGGACCG<br>TCAGTCTTCCTCTTCCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCTTA<br>TATTCAAAGCTCACCGTGACAAG<br>AGCAGGTGGCAGCAGGGGAACGTC<br>TTCTCATGCTCCGTGATGCATGAG<br>GCTCTGCACAACCACTACACGCAG<br>AAGAGCCCTCTCCCTGTCTCCGGG<br>AAATGA | | | |
| 7G6-<br>HCzu17 | With leader [SEQ ID NO:<br>342]:<br>ATGGGCTGGTCCTGCATCATCCTG<br>TTTCTGGTGGCCACCGCCACCGGC<br>GTGCACAGCGAAGTGCAGCTGCTG<br>GAATCTGGGGGCGGACTGGTGCAG<br>CCTGGCGGCTCTCTGCGACTCTCT<br>TGTGCCGCCTCCGGCTACACCTTC<br>ACCACCTACTGGATCACCTGGGTC<br>CGACAGGCTCCAGGGAAGGGACTG<br>GAATGGGTTCCATCTGCAACTACCCC<br>GGCTCCTCCATCTGCAACTACAAC<br>GAGAAGTTCAAGTCCCGGTTCACC<br>ATCTCCGTGGACAACTCCAAGAAC<br>ACCCTGTACCTGCAGATGAACTCC<br>CTGAGAGCCGAGGACACCGCCGTG<br>TACTACTGCGCCAGAGAGGACGGC<br>TACGACGTTGGTTTGCTTACTGG<br>GGCCAGGGCACCCTGGTCACCGTG | With leader [SEQ ID<br>NO: 344]:<br>MGWSCIILFLVATATGVHSEVQ<br>LLESGGGLVQPGGSLRLSCAAS<br>GYTFTTYWITWVRQAPGKGLEW<br>VSDIYPGSSICNYNEKFKSRFT<br>ISVDNSKNTLYLQMNSLRAEDT<br>AVYYCAREDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP | ATGGGCTG<br>GTCCTGCA<br>TCATCCTG<br>TTTCTGGT<br>GGCCACCG<br>CCACCGGC<br>GTGCACAG<br>C<br>(Nucleotides<br>1 to 57 of<br>SEQ ID<br>NO: 342)<br>[SEQ ID<br>NO: 346] | GAAGTGCAGCTGCTGGAA<br>TCTGGCGGCGGACTGGTG<br>CAGCCTGGCGGCTCTCTG<br>AGACTGTCTGTGCCGCC<br>TCCGGCTACACCTTCACC<br>ACCTACTGGATCACCTGG<br>GTCCGACAGGCTCCGGC<br>AAGGGACTGGAATGGGTC<br>TCCGACATCTACCCGGC<br>TCCTCCATCTGCAACTAC<br>AACGAGAAGTTCAAGTCC<br>CGGTTCACCATCTCCGTG<br>GACAACTCCAAGAACACC<br>CTGTACCTGCAGATGAAC<br>TCCCTGAGAGCCGAGGAC<br>ACCGCCGTGTACTACTGC<br>GCCAGAGAGGACGGCTAC<br>GACGCTTGGTTTGCTTAC<br>TGGGGCCAGGGCACCCTG | GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA |

TABLE 1-continued

| | | |
|---|---|---|
| TCATCTGCATCCAAGGGCCCA | SRDELTKNQVSLTCLVKGFYPS | GTCACCGTGTCATCT |
| TCGGTCTTCCCCCTGGCACCCTCC | DIAVEWESNGQPENNYKTTPPV | (Nucleotides 58 to |
| TCCAAGAGCACCTCTGGGGCACA | LDSDGSFFLYSKLTVDKSRWQQ | 414 of SEQ ID NO: |
| GCCGCCCTGGGCTGCCTGGTCAAG | GNVFSCSVMHEALHNHYTQKSL | 342) |
| GACTACTTCCCCGAACCGGTGACG | SLSPGK | [SEQ ID NO: 347] |
| GTGTCGTGGAACTCAGGCGCCCTG | Without leader [SEQ ID | EVQLLESGGGLVQPGGSL |
| ACCAGCGGCGTGCACACCTTCCCG | NO: 345]: | RLSCAASGYTFTTYWITW |
| GCTGTCCTACAGTCCTCAGGACTC | EVQLLESGGGLVQPGGSLRLSC | VRQAPGKGLEWVSDIYPG |
| TACTCCCTCAGCAGCGTGGTGACC | AASGYTFTTYWITWVRQAPGKG | SSICNYNEKFKSRFTISV |
| GTGCCCTCCAGCAGCTTGGGCACC | LEWVSDIYPGSSICNYNEKFKS | DNSKNTLYLQMNSLRAED |
| CAGACCTACATCTGCAACGTGAAT | RFTISVDNSKNTLYLQMNSLRA | TAVYYCAREDGYDAWFAY |
| CACAAGCCCAGCAACACCAAGGTG | EDTAVYYCAREDGYDAWFAYWG | WGQGTLVTVSS |
| GACAAGAAAGTTGAGCCCAAATCT | QGTLVTVSSASTKGPSVFPLAP | [SEQ ID NO: 348] |
| TGTGACAAAACTCACACATGCCCA | SSKSTSGGTAALGCLVKDYFPE | |
| CCGTGCCCAGCACCTGAACTCCTG | PVTVSWNSGALTSGVHTFPAVL | |
| GGGGGACCGTCAGTCTTCCTCTTC | QSSGLYSLSSVVTVPSSSLGTQ | |
| CCCCCAAAACCCAAGGACACCCTC | TYICNVNHKPSNTKVDKKVEPK | |
| ATGATCTCCCGGACCCCTGAGGTC | SCDKTHTCPPCPAPELLGGPSV | |
| ACATGCGTGGTGGTGGACGTGAGC | FLFPPKPKDTLMISRTPEVTCV | |
| CACGAAGACCCTGAGGTCAAGTTC | VVDVSHEDPEVKFNWYVDGVEV | |
| AACTGGTACGTGGACGGCGTGGAG | HNAKTKPREEQYNSTYRVVSVL | |
| GTGCATAATGCCAAGACAAAGCCG | TVLHQDWLNGKEYKCKVSNKAL | |
| CGGGAGGAGCAGTACAACAGCACG | PAPIEKTISKAKGQPREPQVYT | |
| TACCGTGTGGTCAGCGTCCTCACC | LPPSRDELTKNQVSLTCLVKGF | |
| GTCCTGCACCAGGACTGGCTGAAT | YPSDIAVEWESNGQPENNYKTT | |
| GGCAAGGAGTACAAGTGCAAGGTC | PPVLDSDGSFFLYSKLTVDKSR | |
| TCCAACAAAGCCCTCCCAGCCCCC | WQQGNVFSCSVMHEALHNHYTQ | |
| ATCGAGAAAACCATCTCCAAAGCC | KSLSLSPGK | |
| AAAGGGCAGCCCCGAGAACCACAG | | |
| GTGTACACCCTGCCCCCATCCCGG | | |
| GATGAGCTGACCAAGAACCAGGTC | | |
| AGCCTGACCTGCCTGGTCAAAGGC | | |
| TTCTATCCCAGCGACATCGCCGTG | | |
| GAGTGGGAGAGCAATGGGCAGCCG | | |
| GAGAACAACTACAAGACCACGCCT | | |
| CCCGTGCTGGACTCCGACGGCTCC | | |
| TTCTTCCTCTATAGCAAGCTCACC | | |
| GTGGACAAGAGCAGGTGGCAGCAG | | |
| GGGAACGTCTTCTCATGCTCCGTG | | |
| ATGCATGAGGCTCTGCACAACCAC | | |
| TACACGCAGAAGAGCCTCTCCCTG | | |
| TCTCCGGGGAAATGA | | |
| Without leader [SEQ ID | | |
| NO: 343]: | | |
| GAAGTGCAGCTGCTGGAATCTGGC | | |
| GGCGGACTGGTGCAGCCTGGCGGC | | |
| TCTCTGAGACTGTCTTGTGCCGCC | | |
| TCCGGCTACACCTTCACCACCTAC | | |
| TGGATCACTTGGGTCCGACAGGCT | | |
| CCCGGCAAGGGACTGGAATGGGTC | | |
| TCCGACATCTACCCCGGCTCCTCC | | |
| ATCTGCAATTACAACGAGAAGTTC | | |
| AAGTCCCGGTTCACCATCTCCGTG | | |

| | | |
|---|---|---|
| | | CCTGAACTCCTGGGGGGA |
| | | CCGTCAGTCTTCCTCTTC |
| | | CCCCCAAAACCCAAGGAC |
| | | ACCCTCATGATCTCCCGG |
| | | ACCCCTGAGGTCACATGC |
| | | GTGGTGGTGGACGTGAGC |
| | | CACGAAGACCCTGAGGTC |
| | | AAGTTCAACTGGTACGTG |
| | | GACGGCGTGGAGGTGCAT |
| | | AATGCCAAGACAAAGCCG |
| | | CGGGAGGAGCAGTACAAC |
| | | AGCACGTACCGTGTGGTC |
| | | AGCGTCCTCACCGTCCTG |
| | | CACCAGGACTGGCTGAAT |
| | | GGCAAGGAGTACAAGTGC |
| | | AAGGTCTCCAACAAAGCC |
| | | CTCCCAGCCCCCATCGAG |
| | | AAAACCATCTCCAAAGCC |
| | | AAAGGGCAGCCCCGAGAA |
| | | CCACAGGTGTACACCCTG |
| | | CCCCCATCCCGGGATGAG |
| | | CTGACCAAGAACCAGGTC |
| | | AGCCTGACCTGCCTGGTC |
| | | AAAGGCTTCTATCCCAGC |
| | | GACATCGCCGTGGAGTGG |
| | | GAGAGCAATGGGCAGCCG |
| | | GAGAACAACTACAAGACC |
| | | ACGCCTCCCGTGCTGGAC |
| | | TCCGACGGCTCCTTCTTC |
| | | CTTATATTCAAAGCTCACC |
| | | GTGGACAAGAGCAGGTGG |
| | | CAGCAGGGGAACGTCTTC |
| | | TCATGCTCCGTGATGCAT |
| | | GAGGCTCTGCACAACCAC |
| | | TACACGCAGAAGAGCCTC |
| | | TCCCTGTCTCCGGG |
| | | (Nucleotides 415 |
| | | to 1401 of SEQ ID |
| | | NO: 342) |
| | | [SEQ ID NO: 349] |
| | | ASTKGPSVFPLAPSSKST |
| | | SGGTAALGCLVKDYFPEP |
| | | VTVSWNSGALTSGVHTFP |
| | | AVLQSSGLYSLSSVVTVP |
| | | SSSLGTQTYICNVNHKPS |
| | | NTKVDKKVEPKSCDKTHT |
| | | CPPCPAPELLGGPSVFLF |
| | | PPKPKDTLMISRTPEVTC |
| | | VVVDVSHEDPEVKFNWYV |
| | | DGVEVHNAKTKPREEQYN |
| | | STYRVVSVLTVLHQDWLN |
| | | GKEYKCKVSNKALPAPIE |
| | | KTISKAKGQPREPQVYTL |

TABLE 1-continued

| | | |
|---|---|---|
| | GACAACTCCAAGAACACCCTGTAC<br>CTCCAGATGAACTCCCTGAGAGCC<br>GAGACACCGCCGTGTACTACTGC<br>GCCAGAGAGGACCGCTACGACGCT<br>TGGTTTGCTTACTGGGGCCAGGGC<br>ACCCTGGTCACCGTGTCATCTGCA<br>TCCACCAAGGGCCCATCGGTCTTC<br>CCCCTGGCACCCTCCTCCAAGAGC<br>ACCTCTGGGGGCACAGCGGCCCTG<br>GGCTGCCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTA<br>CAGTCCTCAGGACTCTACTCCCTC<br>AGCAGCGTGGTGACCGTGCCCTCC<br>AGCAGCTTGGGCACCCAGACCTAC<br>ATCTGCAACGTGAATCACAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCTGGGGGGACCG<br>TCAGTCTTCCTCTTCCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCTTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | PPSRDELTKNQVSLTCLV<br>KGFYPSDIAVEWESNGQP<br>ENNYKTTPPVLDSDGSFF<br>LYSKLTVDKSRWQQGNVF<br>SCSVMHEALHNHYTQKSL<br>SLSPGK<br>[SEQ ID NO: 350] |

| | | | |
|---|---|---|---|
| 7G6-<br>HCzu18 | With leader [SEQ ID NO: 351]:<br><u>ATGGGGCTGGTCCTGCATCATCCTG</u><br><u>TTTCTGTGGTGGCCACCGCCGGC</u><br>ATGGGCTG<br>GTCCTGCA<br>TCATCCTG<br>TTTCTGT | With leader [SEQ ID NO: 353]:<br><u>MGWSCIILFLVATATGVHSEVQ</u><br>LLESGGGLVQPGGSLRLSCAAS<br>MGWSCIILFLVATATGVHSEVQ<br>LLESGGGLVQPGGSLRLSCAAS | GAAGTGCAGCTGCTGGAA<br>TCTGGCGGCGGACTGGTG<br>CAGCCTGGCGGCTCTCTG<br>AGACTGTCTTGTGCCGCC | GCATCCACCAAGGGCCCA<br>TCGGTCTTCCCCCTGGCA<br>CCCTCCTCCAAGAGCACC<br>TCTGGGGGCACAGCGGCC |

TABLE 1-continued

| | | | |
|---|---|---|---|
| GTGCACAGCGAAGTGCAGCTGCTG | GYTFTTYWITWRQAPGKGLEW | GGCCACCG | TCCGGCTACACCTTCACC | CTGGGCTGCCTGGTCAAG |
| GAATCTGGGCGGCGGACTGGTGCAG | VSDIYPGSSICNYNEKFKSRFT | CCACCGGC | ACCTACTGATCACCTGG | GACTACTTCCCCGAACCG |
| CCTGGCGGTCTCTCGGCTGACTGTCT | ISRDNSKNTLYLQMNSLRAEDT | GTGCACAG | GTCCGACAGGCTCCCGGC | GTGACGGTGTCGTGAAC |
| TGTGCCGCCTCCGGCTACACCTTC | AVYYCAREDGYDAWFAYWGQGT | C | AAGGGACTGGAATGGGTC | TCAGGCGCCTGACCAGC |
| ACCACCTACTGGATCACCTGGGTC | LVTVSSASTKGPSVFPLAPSSK | (Nucleotides | TCCGACATCTACCCCGGC | GGCGTGCACACCTTCCCG |
| CGACAGGCTCCCGGCAAGGGACTG | STSGGTAALGCLVKDYFPEPVT | 1 | TCCTCCATCTGCAACTAC | GCTGTCCTACAGTCCTCA |
| GAATGGGTCTCCGACATCTACCCC | VSWNSGALTSGVHTFPAVLQSS | uc 1 | AACGAGAAGTTCAAGTCC | GGACTCTACTCCCTGAGC |
| GGCTCCTCCATCTGCAACTACAAC | GLYSLSSVVTVPSSSLGTQTYI | to 57 of SEQ ID | CGGTTCACCATCTCCCGG | AGCGTGGTGACCGTGCCC |
| GAGAAGTTCAAGTCCCGGTTCACC | CNVNHKPSNTKVDKKVEPKSCD | NO: 351 | GACAACTCCAAGAACACC | TCCAGCAGCTTGGGCACC |
| ATCTCCCGGGACAACTCCAAGAAC | KTHTCPPCPAPELLGGPSVFLF | [SEQ ID | CTGTACCTCCAGATGAAC | CAGACCTACATCTGCAAC |
| ACCCTGTACCTCCAGATGAACTCC | PPKPKDTLMISRTPEVTCVVVD | NO: 355] | TCCCTGAGAGCCGAGGAC | GTGAATCACAAGCCCAGC |
| CTGAGAGCCGAGGACACCGCCGTG | VSHEDPEVKFNWYVDGVEVHNA | [SEQ ID NO: 356] | ACCGCCGTGTACTACTGC | AACACCAAGGTGGACAAG |
| TACTACTGCGCCAGAGAGGACGGC | KTKPREEQYNSTYRVVSVLTVL | | GCCAGAGAGGACGGCTAC | AAAGTTGAGCCAAATCT |
| TACGACGCTTGGTTTGCTTACTGG | HQDWLNGKEYKCKVSNKALPAP | | GACGCTTGGTTTGCTTAC | TGTCACAAACTCACACA |
| GGCCAGGGCACCCTGGTCACCGTG | IEKTISKAKGQPREPQVYTLPP | | TGGGGCCAGGGCACCCTG | TGCCCACCCCCAGCA |
| TCATCTGCATCCACCAAGGGCCCA | SRDELTKNQVSLTCLVKGFYPS | | GTCACCGTGTCATCT | CCTGAACTCCTGGGGGGA |
| TCGGTTCTTCCCCTGGCACCCTCC | DIAVEWESNGQPENNYKTTPPV | | (Nucleotides 58 to | CCGTCAGTCTTCTCTTC |
| TCCAAGAGCACCTCTGGGGGCACA | LDSDGSFFLYSKLTVDKSRWQQ | | 414 of SEQ ID NO: | CCCCAAAACCCAAGGAC |
| GCGGCCCTGGGCTGCCTGGTCAAG | GNVFSCSVMHEALHNHYTQKSL | | 351) | ACCCTGATGATCTCCCGG |
| GACTACTTCCCCGAACCGGTGACG | SLSPGK | | | ACCCCTGAGGTCACATGC |
| GTGTCGTGGAACTCAGGCGCCCTG | Without leader [SEQ ID | | EVQLLESGGGLVQPGGSL | GTGTGGTGGACGTGAGC |
| ACCAGCGGCGTGCACACCTTCCCG | NO: 354] | | RLSCAASGYTFTTYWITW | CACGAAGACCCTGAGGTC |
| GCTGTCCTACAGTCCTCAGGACTC | EVQLLESGGGLVQPGGSLRLSC | | VRQAPGKGLEWVSDIYPG | AAGTTCAACTGGTACGTG |
| TACTCCCTGAGCAGCGTGGTGACC | AASGYTFTTYWITWVRQAPGKG | | SSICNYNEKFKSRFTISR | GACGGCGTGGAGGTGCAT |
| GTGCCCTCCAGCAGCTTGGGCACC | LEWVSDIYPGSSICNYNEKFKS | | DNSKNTLYLQMNSLRAED | AATGCCAAGACAAAGCCG |
| CAGACCTACATCTGCAACGTGAAT | RFTISRDNSKNTLYLQMNSLRA | | TAVYYCAREDGYDAWFAY | CGGGAGGAGCAGTACAAC |
| CACAAGCCCAGCAACACCAAGGTG | EDTAVYYCAREDGYDAWFAYWG | | WGQGTLVTVSS | AGCACGTACCGTGTCGTC |
| GACAAGAAGTTGAGCCCAAATCT | QGTLVTVSSASTKGPSVFPLAP | | [SEQ ID NO: 357] | AGCGTCCTCACCGTCCTG |
| TGTGACAAACTCACACATGCCCA | SSKSTSGGTAALGCLVKDYFPE | | | CACCAGGACTGGCTGAAT |
| CCGTGCCCAGCACCTGAACTCTG | PVTVSWNSGALTSGVHTFPAVL | | | GGCAAGGAGTACAAGTGC |
| GGGGGACCGTCAGTCTTCCTCTTC | QSSGLYSLSSVVTVPSSSLGTQ | | | AAGGTCTCCAACAAAGCC |
| CCCCCAAAACCCAAGGACACCCTC | TYICNVNHKPSNTKVDKKVEPK | | | CTCCCAGCCCCATCGAG |
| ATGATCTCCCGGACCCCTGAGGTC | SCDKTHTCPPCPAPELLGGPSV | | | AAAACCATCTCCAAAGCC |
| ACATGCGTGTGCTGTGGACGTGAGC | FLFPPKPKDTLMISRTPEVTCV | | | AAAGGGCAGCCCCGAGAA |
| CACGAAGACCCTGAGGTCAAGTTC | VVDVSHEDPEVKFNWYVDGVEV | | | CCAGGTGTACACCCTG |
| AACTGGTACGTGGACGGCGTGGAG | HNAKTKPREEQYNSTYRVVSVL | | | CCCCCATCCCGGGATGAG |
| GTGCATAATGCCAAGACAAAGCCG | TVLHQDWLNGKEYKCKVSNKAL | | | CTGACCAAGAACCAGGTC |
| CGGGAGGAGCAGTACAACAGCACG | PAPIEKTISKAKGQPREPQVYT | | | AGCCTGACCTGCCTGGTC |
| TACCGTGTGGTCAGCGTCCTCACC | LPPSRDELTKNQVSLTCLVKGF | | | AAAGGCTTCTATCCCAGC |
| GTCCTGCACCAGGACTGGCTGAAT | YPSDIAVEWESNGQPENNYKTT | | | GACATCGCCGTGGAGTGG |
| GGCAAGGAGTACAAGTGCAAGGTC | PPVLDSDGSFFLYSKLTVDKSR | | | GAGAGCAATGGGCAGCCG |
| TCCAACAAAGCCCTCCCAGCCCCC | WQQGNVFSCSVMHEALHNHYTQ | | | GAGAACAACTACAAGACC |
| ATCGAGAAAACCATCTCCAAAGCC | KSLSLSPGK | | | ACGCCTCCCGTGCTGGAC |
| AAAGGGCAGCCCCGAGAACCACAG | | | | TCCGACGGCTCCTTCTTC |
| GTGTACACCCTGCCCCATCCCGG | | | | TTATATTCAAAGCTCACC |
| GATGAGCTGACCAAGAACCAGGTC | | | | GTGACAAGAGCAGGTGG |
| AGCCTGACCTGCCTGGTCAAAGGC | | | | CAGCAGGGGAACGTCTTC |
| TTCTATCCCAGCGACATCGCCGTG | | | | TCATGCTCCGTGATGCAT |
| GAGTGGGAGAGCAATGGGCAGCCG | | | | GAGGCTCTGCACAACCAC |
| GAGAACAACTACAAGACCACGCCT | | | | TACACGCAGAAGAGCCTC |
| CCCGTGCTGGACTCCGACGGCTCC | | | | TCCCTGTCTCCGGG |
| TTCTTCCTCTATATTCAAAGCTCACC | | | | (Nucleotides 415 |
| GTGACAAGCAGGTGGCAGCAG | | | | to 1401 of SEQ ID |

TABLE 1-continued

GGGAACGTCTTCTCATGCTCCGTG
ATGCATGAGGCTCTGCACAACCAC
TACACGCAGAAGAGCCCTCTCCCTG
TCTCCCGGGAAATGA
Without leader [SEQ ID
NO: 352]:
GAAGTGCAGCTGCTGGAATCTGGC
GGCGGACTGGTCAGCCTGGCGGC
TCTCTGAGACTGTCTTGTGCCGCC
TCCGGCTACACCTTCACCACCTAC
TGGATCACCTGGGTCCGACAGGCT
CCCGGCAAGGGACTGGAATGGGTC
TCCGACATCTACCCCGGCTCCTCC
ATCTGCAACTACAACGAGAAGTTC
AAGTCCCGTTCACCATCTCCCGG
GACAACTCCAAGAACACCCTGTAC
CTCCAGATGAACTCCCTGAGAGCC
GAGGACACCGCCGTGTACTACTGC
GCCAGAGAGACCGGCTACGACGCT
TGGTTTGCTTACTGGGGCCAGGGC
ACCCTGGTCACCGTGTCATCTGCA
TCCACCAAGGGCCCATCCGTCTTC
CCCCTGGCACCCTCCTCCAAGAGC
ACCTCTGGGGGCACAGCGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCTGGGGGGACCG
TCAGTCTTCCTCTTCCCCCCCAAAA
CCCAAGGACACCCTCATGATCTCC
CGGACCCCTGAGGTCACATGCGTG
GTGGTGGACGTGAGCCACGAAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC
CAGGACTGGCTGAATGGCAAGGAG
TACAAGTGCAAGGTCTCCAACAAA
GCCCTCCCAGCCCCCATCGAGAAA
ACCATCTCCAAAGCCAAAGGGCAG
CCCCGAGAACCACAGGTGTACACC
CTGCCCCCATCCCGGGATGAGCTG
ACCAAGAACCAGGTCAGCCTGACC
TGCCTGGTCAAAGGCTTCTATCCC NO: 351)
[SEQ ID NO: 358]
ASTKGPSVFPLAPSSKST
SGGTAALGCLVKDYFPEP
VTVSWNSGALTSGVHTFP
AVLQSSGLYSLSSVVTVP
SSSLGTQTYICNVNHKPS
NTKVDKKVEPKSCDKTHT
CPPCPAPELLGGPSVFLF
PPKPKDTLMISRTPEVTC
VVVDVSHEDPEVKFNWYV
DGVEVHNAKTKPREEQYN
STYRVVSVLTVLHQDWLN
GKEYKCKVSNKALPAPIE
KTISKAKGQPREPQVYTL
PPSRDELTKNQVSLTCLV
KGFYPSDIAVEWESNGQP
ENNYKTTPPVLDSDGSFF
LYSKLTVDKSRWQQGNVF
SCSVMHEALHNHYTQKSL
SLSPGK
[SEQ ID NO: 359]

TABLE 1-continued

| | | | |
|---|---|---|---|
| | | AGCCACATCGCCGTGGAGTGGGAG | GAAGTGCAGCTGCTGGAA | GCATCCACCAAGGGCCCA |
| | | AGCAATGGCAGCCGGAGAACAAC | TCTGGCGGCGGACTGGTG | TCGGTCTTCCCCCTGGCA |
| | | TACAAGACCACGCCTCCCGTGCTG | CAGCCTGGCGGCTCTCTG | CCCTCCTCCAAGAGCACC |
| | | GACTCCGACGGCTCCTTCTTCTTA | AGACTGTCTTGTGCCGCC | TCTGGGCTGCACCTG |
| | | TATTCAAAGCTCACCGTGGACAAG | TCCGGCTACACCTTCACC | CTGGGCTGCCTGGTCAAG |
| | | AGCAGGTGGCAGGGGAACGTC | ACTACTGATCACCTGG | GACTACTTCCCCGAACCG |
| | | TTCTCATGTCCCGTGATGCATGAG | GTCCGACAGGCTCCCGGC | GTGACGGTGTCGTGGAAC |
| | | GCTCTGCACAACCACTACACGCAG | AAGGGACTGGAATGGGTC | TCAGGCGTGCACACCTTC |
| | | AAGAGCCTCTCCCTGTCTCCGGG | TCCGACATCTACCCCGGC | GGCGTGCACACCTTCCCG |
| | | AAATGA | CGACAGGCTCCCGGCAAGGGACTG | CCTCCTACACTCCTCA |
| 7G6- | With leader [SEQ ID NO: | With leader [SEQ ID | ATGGGCTG |
| HCzu19 | 360]: | NO: 362]: | GTCCTGCA |
| | ATGGGCTGGTCCTGCATCATCCTG | MGWSCIILFLVATATGVHSEVQ | TCATCCTG |
| | TTTCTGGTCGCCACCGCCACCGGC | LLESGGGLVQPGGSLRLSCAAS | TTTCTGGT |
| | GTGCACAGCGAAGTGCAGCTGCTG | GYTFTTYWITWVRQAPGKGLEW | GGCCACCG |
| | GAATCTGGCGGCGGACTGGTGCAG | VSDIYPGSSICNYADKFKGRFT | CCACCGGC |
| | CCTGGCGGCTCTCTGAGACTGTCT | ISRDNSKNTLYLQMNSLRAEDT | GTGCACAG |
| | TGTGCCGCCTCCGGCTACACCTTC | AVYYCAREDGYDAWFAYWGQGT | C |
| | ACCACTTACTGGATCACCTGGGTC | LVTVSSASTKGPSVFPLAPSSK | (Nucleotides |
| | CGACAGGCTCCCGGCAAGGGACTG | STSGGTAALGCLVKDYFPEPVT | 1 |
| | GAATGGGTCTCCGACATCTACCCC | VSWNSGALTSGVHTFPAVLQSS | to 57 of |
| | GGCTCCTCCATCTGCAACTACGCC | GLYSLSSVVTVPSSSLGTQTYI | SEQ ID |
| | GACAAGTTCAAGGGCCGGTTCACC | CNVNHKPSNTKVDKKVEPKSCD | NO: 360) |
| | ATCTCCCGGGACAACTCCAAGAAC | KTHTCPPCPAPELLGGPSVFLF | [SEQ ID |
| | ACCCTGTACCTCCAGATGAACTCC | PPKPKDTLMISRTPEVTCVVVD | NO: 364] |
| | CTGAGAGCCGAGGACACCGCCGTG | VSHEDPEVKFNWYVDGVEHNA |  |
| | TACTACTGCGCCAGAGAGACGGC | KTKPREEQYNSTYRVVSVLTVL |  |
| | TACGACGCTTGGTTTGCTTACTGG | HQDWLNGKEYKCKVSNKALPAP |  |
| | GGCCAGGGCACCCTGGTCACCGTG | IEKTISKAGQPREPQVYTLPP |  |
| | TCATCTGCATCCACCAAGGGCCCA | SRDELTKNQVSLTCLVKGFYPS |  |
| | TCGGTCTTCCCCCTGGCACCCTCC | DIAVEWESNGQPENNYKTTPPV |  |
| | TCCAAGAGCACCTCTGGGGGCACA | LDSDGSFFLYSKLTVDKSRWQQ |  |
| | GCGGCCCTGGGCTGCCTGGTCAAG | GNVFSCSVMHEALHNHYTQKSL |  |
| | GACTACTTCCCCGAACCGGTGACG | SLSPGK |  |
| | GTGTCGTGGAACTCAGGCGCCCTG | Without leader [SEQ ID |  |
| | ACCAGCGGCGTGCACACCTTCCCG | NO: 363]: |  |
| | GCTGTCCTACAGTCCTCAGGACTC | EVQLLESGGGLVQPGGSLRLSC | EVQLLESGGGLVQPGGSL |
| | TACTCCCTCAGCAGCGTGGTGACC | AASGYTFTTYWITWVRQAPGKG | RLSCAASGYTFTTYWITW |
| | GTGCCCTCCAGCAGCTTGGGCACC | LEWVSDIYPGSSICNYADKFKG | VRQAPGKGLEWVSDIYPG |
| | CAGACCTACATCTGCAACGTGAAT | RFTISRDNSKNTLYLQMNSLRA | SSICNYADKFKGRFTISR |
| | CACAAGCCCAGCAACACCAAGGTG | EDTAVYYCAREDGYDAWFAYWG | DNSKNTLYLQMNSLRAED |
| | GACAAGAAAGTTGAGCCCAAATCT | QGTLVTVSSASTKGPSVFPLAP | TAVYYCAREDGYDAWFAY |
| | TGTGACAAAACTCACACATGCCCA | SSKSTSGGTAALGCLVKDYFPE | WGQGTLVTVSS |
| | CCGTGCCCAGCCACCTGAACTCCTG | PVTVSWNSGALTSGVHTFPAVL | [SEQ ID NO: 366] |
| | GGGGGACCGTCAGTCTTCCTCTTC | QSSGLYSLSSVVTVPSSSLGTQ |  |
| | CCCCCAAAACCCAAGGACACCCTC | TYICNVNHKPSNTKVDKKVEPK |  |
| | ATGATCTCCCGGACCCCTGAGGTC | SCDKTHTCPPCPAPELLGGPSV |  |
| | ACATGCGTGGTGGTGGACGTCAAGTTC | FLFPPKPKDTLMISRTPEVTCV |  |
| | CACGAAGACCCTGAGGTCAAGTTC | VVDVSHEDPEVKFNWYVDGVEV |  |
| | AACTGGTACGTGGACGGCGTGGAG | HNAKTKPREEQYNSTYRVVSVL |  |
| | GTGCATAATGCCAAGACAAAGCCG | TVLHQDWLNGKEYKCKVSNKAL |  |
| | CGGGAGGAGCAGTACAACAGCACG | PAPIEKTISKAKGQPREPQVYT |  |

TABLE 1-continued

```
TACCGTGTGGTCAGCGTCCTCACC        LPPSRDELTKNQVSLTCLVKGF      AAAGCTTCTATCCCAGC
GTCCTGCACCAGACTGGCTGAAT         YPSDIAVEWESNGQPENNYKTT      GACATGGCCCTGGAGTGG
GGCAAGGAGTACAAGTGCAAGGTC        PPVLDSDGSFFLYSKLTVDKSR      GAGAGCAATGGGCAGCCG
TCCAACAAAGCCCTCCCAGCCCCC        WQQGNVFSCSVMHEALHNHYTQ      GAGAACAACTACAAGACC
ATCGAGAAACCATCTCCAAGGCC         KSLSLSPGK                   ACGCCTCCCGTGCTGGAC
AAAGGGCAGCCCCGAGAACCACAG                                    TCCGACGGCTCCTTCTTC
GTGTACACCCTGCCCCCATCCCGG                                    TTATATTCAAAGCTCACC
GATGAGCTGACCAAGAACCAGGTC                                    GTGGACAAGAGCAGGTGG
AGCCTGACCTGCCTGGTCAAAGGC                                    CAGCAGGGGAACGTCTTC
TTCTATCCCAGCGACATCGCCGTG                                    TCATGCTCCGTGATGCAT
GAGTGGGAGAGCAATGGGCAGCCG                                    GAGGCTCTGCACAACCAC
GAGAACAACTACAAGACCACGCCT                                    TACACGCAGAAGAGCCTC
CCCGTGCTGGACTCCGACGGCTCC                                    TCCCTGTCTCCGGG
TTCTTCTTATATTCAAAGCTCACC                                    (Nucleotides 415
GTGGACAAGAGCAGGTGGCAGCAG                                    to 1401 of SEQ ID
GGGAACGTCTTCTCATGCTCCGTG                                    NO: 360)
ATGCATGAGGCTCTGCACAACCAC                                    [SEQ ID NO: 367]
TACACGCAGAAGAGCCTCTCCCTG                                    ASTKGPSVFPLAPSSKST
TCTCCGGGAAATGA                                              SGGTAALGCLVKDYFPEP
Without leader [SEQ ID                                      VTVSWNSGALTSGVHTFP
NO: 361]:                                                   AVLQSSGLYSLSSVVTVP
GAAGTGCAGCTGGAATCTGGC                                       SSSLGTQTYICNVNHKPS
GGCGGACTGGTGCAGCCTGGCGC                                     NTKVDKKVEPKSCDKTHT
TCTCTGAGACTGTCTTGTGCCGCC                                    CPPCPAPELLGGPSVFLF
TCCGGCTACACCTTCACCACCTAC                                    PPKPKDTLMISRTPEVTC
TGGATCACCTGGGTCCGACAGGCT                                    VVVDVSHEDPEVKFNWYV
CCCGGCAAGGGACTGGAATGGGTC                                    DGVEVHNAKTKPREEQYN
TCCACATTCTACCCGGCTCCTCC                                     STYRVVSVLTVLHQDWLN
ATCTGCAACTACGCCGAACAGTTC                                    GKEYKCKVSNKALPAPIE
AAGGGCCGGTTCACCATCTCCCGG                                    KTISKAKGQPREPQVYTL
GACAACTCCAAGAACACCCTGTAC                                    PPSRDELTKNQVSLTCLV
CTCCAGATGAACTCCCTGAGAGCC                                    KGFYPSDIAVEWESNGQP
GAGGACACCGCCGTGTACTACTGC                                    ENNYKTTPPVLDSDGSFF
GCCAGAGAGGACGGCTACGACGCT                                    LYSKLTVDKSRWQQGNVF
TGGTTTGCTTACTGGGGCCAGGGC                                    SCSVMHEALHNHYTQKSL
ACCCTGGTCACCGTGTCATCTGCA                                    SLSPGK
TCCACCAAGGGCCCATCCGTCTTC                                    [SEQ ID NO: 368]
CCCCTGGCACCCTCCTCCAAGAGC
ACCTCTGGGGGCACAGCGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCTCAGGACTCTACTCCCTC
AGCAGCGTTGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCCTGGGGGGACCG
TCAGTCTTCCTCTTCCCCCCAAAA
CCCAAGGACACCCTCATGATCTCC
```

TABLE 1-continued

| | | | |
|---|---|---|---|
| | CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCCTG<br>TATTCAAAGCTCACCGTGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCCGGG<br>AAATGA | | |
| 7G6-<br>HCzu20 | With leader [SEQ ID NO:<br>369]:<br>ATGGGGCTGGTCCTGCATCATCCTG<br>TTTCTGGTGGCCACCGCCACCGGC<br>GTGCACAGCGAAGTGCAGCTGCTG<br>GAATCTGGCGGCCGAGCTGTGCTG<br>CCTGGCGGCTCTCTGAGACTGTCT<br>TGTGCCGCCTCCGGCTACACCTTC<br>ACCACTACTGGATCACCTGGGTC<br>CGACAGGCTCCCGCAAGGGAGTC<br>GAATGGGTCTCCGACATCTACCCC<br>GGCTCCTCCATCTGCAACTACGCC<br>GACAAGTTCAAGGGCCGGTTCACC<br>ATCTCCCGACACTCCAAGAAC<br>ACCCTGTACCTGCAGATGAACTCC<br>CTGAGAGCCGAGGACACCGCGTG<br>TACTACTGCGCCAAAGAGACGGC<br>TACGACGTGTTGGTTTGCTTACTGG<br>GGCCAGGGCACCCTGGTCACCGTG<br>TCATCTGCATCCACCAAGGGCCCA<br>TCGGTCTTCCCCCTGGCACCCTCC<br>TCCAAGAGCACCTCTGGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCCTCAGGACTC | With leader [SEQ ID<br>NO: 371]:<br>MGWSCIILFLVATATGVHSEVQ<br>LLESGGGLVQPGGSLRLSCAAS<br>GYTFTTYWITWVRQAPGKGLEW<br>VSDIYPGSSICNYADKFKGRFT<br>ISRDNSKNTLYLQMNSLRAEDT<br>AVYYCAKEDGYDAWFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI<br>CNVNHKPSNTKVDKKVEPKSCD<br>KTHTCPPCPAPELLGGPSVFLF<br>PPKPKDTLMISRTPEVTCVVVD<br>VSHEDPEVKFNWYVDGVEVHNA<br>KTKPREEQYNSTYRVVSVLTVL<br>HQDWLNGKEYKCKVSNKALPAP<br>IEKTISKAKGQPREPQVYTLPP<br>SRDELTKNQVSLTCLVKGFYPS<br>DIAVEWESNGQPENNYKTTPPV<br>LDSDGSFFLYSKLTVDKSRWQQ<br>GNVFSCSVMHEALHNHYTQKSL<br>SLSPGK<br>Without leader [SEQ ID<br>NO: 372]:<br>EVQLLESGGGLVQPGGSLRLSC | ATGGGCTG<br>GTCCTGCA<br>TCATCCTG<br>TTTCTGGT<br>GGCCACCG<br>CCACCGGC<br>GTGCACAG<br>C<br>(Nucleotides<br>1 to 57 of<br>SEQ ID<br>NO: 369)<br>[SEQ ID<br>NO: 373] | GAAGTGCAGCTGCTGGAA<br>TCTGCGCGGCCGACTGGTG<br>CAGCCTGGCGGCTCTCTG<br>AGACTGTCTTGTGCCGCC<br>TCCGGCTACACCTTCACC<br>ACCTACTGGATCACCTGG<br>GTCCGACAGGCTCCCGGC<br>AAGGGACTGGAATGGGTC<br>TCCGACATCTACCCCGGC<br>TCCTCCATCTGCAACTAC<br>GCCGACAAGTTCAAGGGC<br>CGGTTCACCATCTCCCGG<br>GACAACTCCAAGAACACC<br>CTGTACCTGCAGATGAAC<br>TCCCTGAGAGCCGAGGAC<br>ACCGCCGTGTACTACTGC<br>GCCAAAGAGACGGCTAC<br>GACGTTGGTTTGCTTAC<br>TGGGGCCAGGGCACCCTG<br>GTCACCGTGTCATCT<br>(Nucleotides 58 to<br>414 of SEQ ID NO:<br>369)<br>[SEQ ID NO: 374]<br>EVQLLESGGGLVQPGGSL<br>RLSCAASGYTFTTYWITW<br>VRQAPGKGLEWVSDIYPG | GCATCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAAGTTGAGCCCAAATCT<br>TGTGACAAAACTCACACA<br>TGCCCACCGTGCCCAGCA<br>CCTGAACTCCTGCGGGGA<br>CCGTCAGTCTTCCTCTTC<br>CCCCCAAAACCAAGGAC<br>ACCCTCATGATCTCCCGG<br>ACCCCTGAGGTCACATGC<br>GTGGTGGTGGACGTGAGC<br>CACGAAGACCCTGAGGTC<br>AAGTTCAACTGGTACGTG |

TABLE 1-continued

| | | |
|---|---|---|
| TACTCCCTCAGCAGCGTGGTGACC | AASGYTFTYWITWVRQAPGKG | SSICNYADKFKGRFTISR |
| GTGCCCTCCAGCAGTTGGGCACC | LEWVSDIYPGSSICNYADKFKG | DNSKNTLYLQMNSLRAED |
| CAGACTACATCTGCAACCTGAAT | RFTISRDNSKNTLYLQMNSLRA | TAVYYCAKEDGYDAWFAY |
| CACAACCCACCACCAACACCCTC | EDTAVYYCAKEDGYDAWFAYWG | WGQGTLVTVSS |
| GACAAGAAGTTGAGCCCAAATCT | QGTLVTVSSASTKGPSVFPLAP | [SEQ ID NO: 375] |
| TGTGACAAAACTCACACATGCCCA | SSKSTSGGTAALGCLVKDYFPE | |
| CCGTGCCCAGCACCTGAACTCTG | PVTVSWNSGALTSGVHTFPAVL | |
| GGGGACCGTCAGTCTTCCTCTTC | QSSGLYSLSSVVTVPSSSLGTQ | |
| CCCAAAACCCAAGGACACCCTC | TYICNVNHKPSNTKVDKKVEPK | |
| ATGATCTCCCGGACCCCTGAGGTC | SCDKTHTCPPCPAPELLGGPSV | |
| ACATGCGTGGTGGTGCACGTGAGC | FLFPPKPKDTLMISRTPEVTCV | |
| CACGAAGACCCTGAGGTCAAGTTC | VVDVSHEDPEVKFNWYVDGVEV | |
| AACTGGTACGTGGACGGCGTGGAG | HNAKTKPREEQYNSTYRVVSVL | |
| GTGCATAATGCCAAGACAAAGCCG | TVLHQDWLNGKEYKCKVSNKAL | |
| CGGGAGGAGCAGTACAACAGCACG | PAPIEKTISKAKGQPREPQVYT | |
| TACCGTGTGGTCAGCCTCCTCACC | LPPSRDELTKNQVSLTCLVKGF | |
| GTCCTGCACCAGGACTGGCTGAAT | YPSDIAVEWESNGQPENNYKTT | |
| GGCAAGGAGTACAAGTGCAAGGTC | PPVLDSDGSFFLYSKLTVDKSR | |
| TCCAACAAAGCCCTCCCAGCCCCC | WQQGNVFSCSVMHEALHNHYTQ | |
| ATCGAGAAACCATCTCCAAAGCC | KSLSLSPGK | |
| AAAGGGCAGCCCCGAGAACCACAG | | |
| GTGTACACCCTGCCCCCATCCCGG | | |
| GATGAGCTGACCAAGAACCAGGTC | | |
| AGCCTGACCTGCCTGGTCAAAGGC | | |
| TTCTATCCCAGCGACATCGCCGTG | | |
| GAGTGGGAGAGCAATGGGCAGCCG | | |
| GAGAACAACTACAAGACCACGCCT | | |
| CCCGTGCTGGACTCCGACGGCTCC | | |
| TTCTTCTTATATTCAAAGCTCACC | | |
| GTGACAAGAGCAGGTGGCAGCAG | | |
| GGGAACGTCTTCTCATGCTCCGTG | | |
| ATGCATGAGGCTCTGCACAACCAC | | |
| TACACGCAGAAGAGCCTCTCCCTG | | |
| TCTCCGGGTAAATGA | | |
| Without leader [SEQ ID | | |
| NO: 370]: | | |
| GAAGTGCAGCTGCTGGAATCTGGC | | |
| GGCGGACTGGTGCAGCCTGGCGGC | | |
| TCTCTGAGACTGTCTTGTGCCGCC | | |
| TCCGGCTACACCTTCACCACCTAC | | |
| TGGATCACCTGGGTCCGACAGGCT | | |
| CCCGGCAAGGGACTGGAATGGGTC | | |
| TCCGACATCTACCCCGGCTCCTCC | | |
| ATCTGCAACTACGCCGACAAGTTC | | |
| AAGGGCCGGTTCACCATCTCCCGG | | |
| GACAACTCCAAGAACACCCTGTAC | | |
| CTGCAGATGAACTCCCTGAGAGCC | | |
| GAGGACACCGCCGTGTACTACTGC | | |
| GCCAAAGAGGACGGCTACGACGCT | | |
| TGGTTTGCTTACTGGGGCCAGGGC | | |
| ACCCTGGTCACCGTGTCATCTGCA | | |
| TCCACCAAGGGCCCATCGGTCTTC | | |
| CCCCTGGCACCCTCTCCAAGAGC | | |

| | | |
|---|---|---|
| | | GACGGCGTGCAGGTGCAT |
| | | AATGCCAAGACAAAGCCG |
| | | CGGGAGGAGCAGTACAAC |
| | | AGCACGTACCGTGTGGTC |
| | | ACCCTCCTCACCCTCTC |
| | | CACCAGGACTGGCTGAAT |
| | | GGCAAGGAGTACAAGTGC |
| | | AAGGTCTCCAACAAAGCC |
| | | CTCCCAGCCCCCATCGAG |
| | | AAAACCATCTCCAAAGCC |
| | | AAAGGGCAGCCCCGAGAA |
| | | CCACAGGTGTACACCCTG |
| | | CCCCCATCCCGGGATGAG |
| | | CTGACCAAGAACCAGGTC |
| | | AGCCTGACCTGCCTGGTC |
| | | AAAGGCTTCTATCCCAGC |
| | | GACATCGCCGTGGAGTGG |
| | | GAGAGCAATGGGCAGCCG |
| | | GAGAACAACTACAAGACC |
| | | ACGCCTCCCGTGCTGGAC |
| | | TCCGACGGCTCCTTCTTC |
| | | TTATATTCAAAGCTCACC |
| | | GTGGACAAGAGCAGGTGG |
| | | CAGCAGGGGAACGTCTTC |
| | | TCATGCTCCGTGATGCAT |
| | | GAGGCTCTGCACAACCAC |
| | | TACACGCAGAAGAGCCTC |
| | | TCCCTGTCTCCGGG |
| | | (Nucleotide 415 to |
| | | 1401 of SEQ ID NO: |
| | | 369) |
| | | [SEQ ID NO: 376] |
| | | ASTKGPSVFPLAPSSKST |
| | | SGGTAALGCLVKDYFPEP |
| | | VTVSWNSGALTSGVHTFP |
| | | AVLQSSGLYSLSSVVTVP |
| | | SSSLGTQTYICNVNHKPS |
| | | NTKVDKKVEPKSCDKTHT |
| | | CPPCPAPELLGGPSVFLF |
| | | PPKPKDTLMISRTPEVTC |
| | | VVVDVSHEDPEVKFNWYV |
| | | DGVEVHNAKTKPREEQYN |
| | | STYRVVSVLTVLHQDWLN |
| | | GKEYKCKVSNKALPAPIE |
| | | KTISKAKGQPREPQVYTL |
| | | PPSRDELTKNQVSLTCLV |
| | | KGFYPSDIAVEWESNGQP |
| | | ENNYKTTPPVLDSDGSFF |
| | | LYSKLTVDKSRWQQGNVF |
| | | SCSVMHEALHNHYTQKSL |
| | | SLSPGK |
| | | [SEQ ID NO: 377] |

| | | | |
|---|---|---|---|
| | ACCTCTGGGGCACAGCGGCCCTG<br>GGCTGCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTA<br>CAGTCCTCAGGACTCTACTCCCTC<br>AGCAGCGTGGTGACCGTGCCCTCC<br>AGCAGCTTGGGCACCCAGACCTAC<br>ATCTGCAACGTGAATCACAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCTGGGGGGACCG<br>TCAGTCTTCCTCTTCCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCCTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | | |
| 7G6-<br>HCzu23 | With leader [SEQ ID<br>NO: 378]:<br>ATGGGCTGGTCCTGCATCATCCTG<br>TTTCTGGTGGCCACCGCCACCGGC<br>GTGCACAGCGAAGTGCAGCTGGTG<br>GAATCTGGCGGCGGACTGGTGCAG<br>CCTGGCGGCTCTCTGAGACTGTCT<br>TGTGCCGCCTCCGGCTACACCTTC<br>ACCACTTACTGGATCACCTGGGTC<br>CGACAGGCTCCCGGCAAGGGACTG<br>GAATGGGTGTCCAGCATCTCCAAC<br>TACGCCGACAGCGTGAAGGGCCGG<br>TTCACCATCTCCCGGGACAACTCCAAG | With leader [SEQ ID<br>NO: 380]:<br>MGWSCIILFLVATATGVHSEVQ<br>LLESGGGLVQPGGSLRLSCAAS<br>GYTFTTYWITWVRQAPGKGLEW<br>VSDIYPGSSISNYADSVKGRFT<br>ISRDNSKNTLYLQMNSLRAEDT<br>AVYYCAREDGYDAMFAYWGQGT<br>LVTVSSASTKGPSVFPLAPSSK<br>STSGGTAALGCLVKDYFPEPVT<br>VSWNSGALTSGVHTFPAVLQSS<br>GLYSLSSVVTVPSSSLGTQTYI | ATGGGCTG<br>GTCCTGCA<br>TCATCCTG<br>TTTCTGGT<br>GGCCACCG<br>CCACCGGC<br>GTGCACAG<br>C (Nucleotides<br>1<br>to 57 of<br>SEQ ID | GAAGTGCAGCTGCTGGAA<br>TCTGGCGGCGGACTGGTG<br>CAGCCTGGCGGCTCTCTG<br>AGACTGTCTTGTGCCGCC<br>TCCGGCTACACCTTCACC<br>ACCTACTGGATCACCTGG<br>GTCCGACAGGCTCCCGGC<br>AAGGGACTGGAATGGGTG<br>TCCGACATCTACCCCGGC<br>TCCTCCATCTCCAACTAC<br>GCCGACTCCGTCAAGGGC<br>CGGTTCACCATCTCCCGG | GCCTCCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCCTCA<br>GGACTCTACTCCCTCAGC<br>AGCGTGGTGACCGTGCCC |

TABLE 1-continued

| | | |
|---|---|---|
| GACTCCGTCAAGGGGCCGGTTCACC | CNVNHKPSNTKVDKKVEPKSCD | GACAACTCCAAGAACACC TCCAGCAGTTGGGCACC |
| AATCCCCGGACACTCCAAGAAC | KTHTCPPCPAPELLGGPSVFLF | CTGTACCTCCAGATGAAC CAGACCTACATCTGCAAC |
| ACCCTGTACCTCCAGATGAACCTG | PPKPKDTLMISRTPEVTCVVVD | TCCCTGCGGGCCGAGGAC GTGAATCACAAGCCCAGC |
| CTGCGGGCCGAGGACACCGCCGTG | VSHEDPEVKFNWYVDGVEVHNA | ACCGCCGTGTACTACTGC AACACCAAGGTGGACAAG |
| TACTACTGCGCCAGAGAGGACGGC | KTKPREEQYNSTYRVVSVLTVL | GCCAGAGAGGACGGCTAC AAAGTTGAGCCAAATCT |
| TACGACGCTTGGTTTGCCTACTGG | HQDWLNGKEYKCKVSNKALPAP | GACGCTTGGTTTGCCTAC TGTGACAAAACTCACACA |
| GGCCAGGGCACCCTGGTCACCGTG | IEKTISKAKGQPREPQVYTLPP | TGGGCCAGGGCACCCTG TGCCCACCGTGCCCAGCA |
| TCATCTGCCTCCACCAAGGGCCCA | SRDELTKNQVSLTCLVKGFYPS | GTCACCGTGTCATCT CCTGAACTCCTGGGGGGA |
| TCGGTCTTCCCCCTGGCACCCTC | DIAVEWESNGQPENNYKTTPPV | (Nucleotides 58 to CCGTCAGTCTTCCTCTTC |
| TCCAAGAGCACCTCTGGGGGCACA | LDSDGSFFLYSKLTVDKSRWQQ | 414 of SEQ ID NO: CCCCCAAAACCCAAGGAC |
| GCGCCCTGGCTGCCTGGTCAAG | GNVFSCSVMHEALHNHYTQKSL | 378) ACCCTCATGATCTCCGG |
| GACTACTTCCCCGAACCGGTGACG | SLSPGK | ACCCCTGAGGTCACATGC |
| GTGTCGTGGACAACTCAGGCGCCCTG | Without leader [SEQ ID | GTGGTGGTGGACGTGAGC CACGAAGACCCTGAGGTC |
| ACCGGCGTGCACACCTTCCCG | NO: 381]: | AAGTTCAACTGGTACGTG GACGGCGTGGAGGTGCAT |
| GCTGTCCTACAGCTCCAGGACTC | EVQLLESGGGLVQPGGSLRLSC | AATGCCAAGACAAAGCCG CGGGAGGAGCAGTACAAC |
| TACTCCCTCAGCAGCGTGTGACC | AASGYTFTTYWITWVRQAPGKG | AGCACGTACCGTGTGTC AGCGTCCTCACCGTCCTG |
| GTGCCCCTCCAGCAGTTGGGCACC | LEWVSDIYPGSSISNYADSVKG | CACCAGGACTGGCTGAAT GGCAAGGAGTACAAGTGC |
| CAGACCTACATCTGCAACGTGAAT | RFTISRDNSKNTLYLQMNSLRA | AAGGTCTCCAACAAAGCC CTCCCAGCCCCCATCGAG |
| CACAACCCACCCTCCCAAGGTG | EDTAVYYCAREDGYDAWFAYWG | AAAACCATCTCCAAAGCC AAAGGGCAGCCCCGAGAA |
| GACAAGAAAGTTGAGCCCAAATCT | QGTLVTVSSASTKGPSVFPLAP | CCACAGGTGTACACCCTG CCCCCATCCCGGGATGAG |
| TGTGACAAAACTCACACATGCCCA | SSKSTSGTAALGCLVKDYFPE | CTGACCAAGAACCAGGTC AGCCTGACCTGCCTGGTC |
| CCGTGCCCAGCTCCGGAACTCCTG | PVTVSWNSGALTSGVHTFPAVL | AAAGGCTTCTATCCCAGC GACATCGCCGTGGAGTGG |
| GGGGGACCGTCAGTCTTCCTCTTC | QSSGLYSLSSVVTVPSSSLGTQ | GAGAGCAATGGGCAGCCG GAGAACAACTACAAGACC |
| CCCCCAAAACCCAAGGACACCCTC | TYICNVNHKPSNTKVDKKVEPK | ACGCCTCCCGTGCTGGAC TCCGACGGCTCCTTCTTC |
| ATGATCTCCCGGACCCCTGAGGTC | SCDKTHTCPPCPAPELLGGPSV | TTATATTCAAAGCTCACC GTGGACAAGAGCAGGTGG |
| ACATGCGTGGTGGTGGACGTGAGC | FLFPPKPKDTLMISRTPEVTCV | CAGCAGGGGAACGTCTTC TCATGCTCCGTGATGCAT |
| CACGAAGACCCTGAGGTCAAGTTC | VVDVSHEDPEVKFNWYVDGVEV | GAGGCTCTGCACAACCAC TACACGCAGAAGAGCCTC |
| AACTGGTACGTGGACGGCGTGGAG | HNAKTKPREEQYNSTYRVVSVL | TCCCTGTCTCCGGG |
| GTGCATAATGCCAAGACAAAGCCG | TVLHQDWLNGKEYKCKVSNKAL | (Nucleotides 415 |
| CGGGAGGAGCAGTACAACAGCACG | PAPIEKTISKAKGQPREPQVYT | to 1401 of SEQ ID |
| TACCGTGTGGTCAGCGTCCTCACC | LPPSRDELTKNQVSLTCLVKGF | NO: 378) |
| GTCCTGCACCAGGACTGGCTGAAT | YPSDIAVEWESNGQPENNYKTT | [SEQ ID NO: 385] |
| GGCAAGGAGTACAAGTGCAAGGTC | PPVLDSDGSFFLYSKLTVDKSR | ASTKGPSVFPLAPSSKST |
| TCCAACAAAGCCCTCCCAGCCCCC | WQQGNVFSCSVMHEALHNHYTQ | SGGTAALGCLVKDYFPEP |
| ATCGAGAAAACCATCTCCAAAGCC | KSLSLSPGK | VTVSWNSGALTSGVHTFP |
| AAAGGGCAGCCCCGAGAACCACAG | | AVLQSSGLYSLSSVVTVP |
| GTGTACACCCTGCCCCCATCCCGG | | SSSLGTQTYICNVNHKPS |
| GATGAGCTGACCAAGAACCAGGTC | | NTKVDKKVEPKSCDKTHT |
| AGCCTGACCTGCCTGGTCAAAGGC | | |
| TTCTATCCCAGCGACATCGCCGTG | | |
| GAGTGGGAGAGCAATGGGCAGCCG | | |
| GAGAACAACTACAAGACCACGCCT | | |
| CCCGTGCTGGACTCCGACGGCTCC | | |
| TTCTTCTTATATTCAAAGCTCACC | | |
| GTGGACAAGAGCAGGTGGCAGCAG | | |
| GGGAACGTCTTCTCATGCTCCGTG | | |
| ATGCATGAGGCTCTGCACAACCAC | | |
| TACACGCAGAAGAGCCTCTCCCTG | | |
| TCTCCGGGTAAATGA | | |
| Without leader [SEQ ID | | |
| NO: 379]: | | |
| GAAGTGCAGCTGCTGGAATCGGC | | |
| GGCGGACTGGTGCAGCCTGGCGGC | | |

TABLE 1-continued

```
TCTCTGAGACTGTCTTGTGCCGCC       CPPCPAPELLGGPSVFLF
TCCGGCTACACCTTCACCACCTAC       PPKPKDTLMISRTPEVTC
TGGATCACTGGGTCCGACAGGCT        VVVDVSHEDPEVKFNWYV
CCCGGCCAAGGGACTGGAATGGGTG      DGVEVHNAKTKPREEQYN
CCGACATCTACCCCGGCTCCTCC        STYRVVSVLTVLHQDWLN
ATCTCCAACTACGCCGACTCCGTC       GKEYKCKVSNKALPAPIE
AAGGGCCGTTCACCATCTCCG          KTISKAKGQPREPQVYTL
GACAACTCCAAGAACACCCTGTAC       PPSRDELTKNQVSLTCLV
CTCCAGATGAACTCCCTGCGGGCC       KGFYPSDIAVEWESNGQP
GAGGACACCGCCGTGTACTACTGC       ENNYKTTPPVLDSDGSFF
GCCAGAGAGGACGGCTACGACGCT       LYSKLTVDKSRWQQGNVF
TGGTTTGCCTACTGGGGCCAGGGC       SCSVMHEALHNHYTQKSL
ACCCTGGTCACCGTGTCATCTGCC       SLSPGK
TCCACCAAGGGCCCATCGGTCTTC       [SEQ ID NO: 386]
CCCCTGGCACCCTCCTCCAAGAGC
ACCTCTGGGGGCACACGGCCCTG
GGCTGCCTGGTCAAGGACTACTTC
CCCGAACCGGTGACGGTGTCGTGG
AACTCAGGCGCCCTGACCAGCGGC
GTGCACACCTTCCCGGCTGTCCTA
CAGTCCCTCAGGACTCTACTCCCTC
AGCAGCGTGGTGACCGTGCCCTCC
AGCAGCTTGGGCACCCAGACCTAC
ATCTGCAACGTGAATCACAAGCCC
AGCAACACCAAGGTGGACAAGAAA
GTTGAGCCCAAATCTTGTGACAAA
ACTCACACATGCCCACCGTGCCCA
GCACCTGAACTCCTGGGGGGACCG
TCAGTCTTCCTCTTCCCCCCAAAA
CCCAAGGACACCCTCATGATCTCC
CGGACCCCTGAGGTCACATGCGTG
GTGGTGGACGTGAGCCACGAAGAC
CCTGAGGTCAAGTTCAACTGGTAC
GTGGACGGCGTGGAGGTGCATAAT
GCCAAGACAAAGCCGCGGGAGGAG
CAGTACAACAGCACGTACCGTGTG
GTCAGCGTCCTCACCGTCCTGCAC
CAGGACTGGCTGAATGGCAAGGAG
TACAAGTGCAAGGTCTCCAACAAA
GCCCTCCCAGCCCCCATCGAGAAA
ACCATCTCCAAAGCCAAAGGGCAG
CCCCGAGAACCACAGGTGTACACC
CTGCCCCCATCCCGGGATGAGCTG
ACCAAGAACCAGGTCAGCCTGACC
TGCCTGGTCAAAGGCTTCTATCCC
AGCGACATCGCCGTGGAGTGGGAG
AGCAATGGGCAGCCGGAGAACAAC
TACAAGACCACGCCTCCCGTGCTG
GACTCCGACGGCTCCTTCTTCTTA
TATTCAAAGCTCACCGTGGACAAG
AGCAGGTGGCAGCAGGGGAACGTC
TTCTCATGCTCCGTGATGCATGAG
GCTCTGCACAACCACTACACGCAG
```

TABLE 1-continued

| | | | | |
|---|---|---|---|---|
| | | AAGAGCCTCTCCCCTGTCTCCCGGG<br>AAATGA | | |
| 7G6-<br>HCzu24 | With leader [SEQ ID NO:<br>387]: | ATGGGCTG<br>GTCCTGCA | With leader [SEQ ID<br>NO: 389]: | GAAGTGCAGCTGTGGAA<br>TCTGGCGGCGGACTGGTG | GCTTCCACCAAGGGCCCA<br>TCGGTCTTCCCCCTGGCA |
| | ATGGGCTGGTCCTGCATCATCCTG | TCATCCTG | MGWSCIILFLVAATGVHSEVQ | CAGCCTGGGGGCTCTG | CCCTCCTCCAAGAGCACC |
| | TTTCTGGTGGCCACCGGCCACCGC | TTTCTGT | LLFSGGGLVQPGGSLRLSCAAS | AGACTGTCTTGTGCCGCC | TCTGGGGGCACAGCGCC |
| | GTGCACAGCGAAGTGCAGCTGCTG | GGCCACCG | GYTFTTWITWRQAPGKGLEW | TCCGGCTACACCTTCACC | CTGGGCTGCCTGGTCAAG |
| | GAATCTGGCGGCGGACTGGTGCAG | CCACCGGC | VSDIYPGSSISNYNEKPKSRFT | ACCTACTGGATCACCTGG | GACTACTTCCCCGAACCG |
| | CCTGGCGGCTCTCTGAGACTGTCT | GTGCACAG | ISRDNSKNTLYLQMNSLRAEDT | GTCCAGACAGGCTCCGGC | GTGACGGTGTCGTGAAC |
| | TGTGCCGCCTCCGGCTACACCTTC | GTGCACAG | AVYYCAREDGYDAWFAYWGQGT | AAGGGACTGGAATGGGTG | TCAGCGGCCCTGACCAGC |
| | ACCACTACTGGATCACCTGGGTC | C | LVTVSSASTKGPSVFPLAPSSK | TCCGACATCTACCCCGGC | GGCGTGCACACCTTCCCG |
| | CGACAGGCTCCCGGCAAGGGACTG | (Nucleotides | STSGGTAALGCLVKDYFPEPVT | TCCTCCATCTCCAACTAC | GCTGTCCTACAGTCCTCA |
| | GAATGGGTGTCCGACATCTACCCC | 1 | VSWNSGALTSGVHTFPAVLQSS | AACGAGAAGTTCAAGTCC | GGACTTCTACCCCTCAGC |
| | GGCTCTTCCATCTCCAACTACAAC | to 57 of | GLYSLSSVVTVPSSSLGTQTYI | CGGTTCACCATCTCCCGG | AGCGTGGTGACCGTGCCC |
| | GAGAAGTTCAAGTCCCGGTTCACC | SEQ ID | CNVNHKPSNTKVDKKVEPKSCD | GACAACTCCAAGAACACC | TCCAGCAGCTTGGGCACC |
| | ATCTCCCGGGACAACTCCAAGAAC | NO: 387) | KTHTCPPCPAPELLGGPSVFLF | CTGTACCTGCAGATGAAC | CAGACCTACATCTGCAAC |
| | ACCCTGTACCTGCAGATGAACTCC | [SEQ ID | PPKPKDTLMISRTPEVTCVVVD | TCCCTGCGGGCCGAGGAC | GTGAATCACAAGCCCAGC |
| | CTGCGGGCCGAGGACACCGCCGTG | NO: 391] | VSHEDPEVKFNWYVDGVEHNA | ACCGCCGTGTACTACTGC | AACACCAAGGTGGACAAG |
| | TACTACTGCGCCAGAGACGGCTAC | | KTKPREEQYNSTYRVVSVLTVL | GCCAGAGACGGCTAC | AAAGTTGAGCCCAAATCT |
| | GACGCTTGGTTTGCCTACTGG | | HQDWLNGKEYKCKVSNKALPAP | GACGCTTGGTTTGCCTAC | TGTGACAAAACTCACACA |
| | GGCCAGGGCACCCTGGTCACCGTG | | IEKTISKAKGQPREPQVVTLPP | TGGGGCCAGGGCACCCTG | TGCCCACCGTGCCCAGCA |
| | TCATCTGCCTCCACCAAGGGCCCA | | SRDELTKNQVSLTCLVKGFYPS | GTCACCGTGTCATCT | CCTGAACTCCTGGGGGGA |
| | TCGGTCTTCCCCCTGGCACCCTCC | | DIAVEWESNGQPENNYKTTPPV | | CCGTCAGTCTTCCTCTTC |
| | TCCAAGAGCACCTCTGGGGGCACA | | LDSDGSFFLYSKLTVDKSRWQQ | [SEQ ID NO: 392] | CCCCCAAAACCCAAGGAC |
| | GCGGCCCTGGGCTGCCTGGTCAAG | | GNVFSCSVMHEALHNHYTQKSL | EVQLLESGGGLVQPGGSL | ACCCTCATGATCTCCCGG |
| | GACTACTTCCCCGAACCGGTGACG | | SLSPGK | RLSCAASGYTFTTYWITW | GTGGTGTGACGTGAGC |
| | GTGTCGTGGAACTCAGGCGCCCTG | | Without leader [SEQ ID | VRQAPGKGLEWVSDIYPG | CACGAAGACCCTGAGGTC |
| | ACCAGCGGCGTGCACACCTTCCCG | | NO: 390]: | SSISNYNEKPKSRFTISR | AAGTTCAACTGGTACGTG |
| | GCTGTCCTACAGTCCTCAGGACTC | | EVQLLESGGGLVQPGGSLRLSC | DNSKNTLYLQMNSLRAED | GACGGCGTGGAGGTGCAT |
| | TACTCCCTCAGCAGCGTGGTGACC | | AASGYTFTTYWITWRQAPGKG | TAVYYCAREDGYDAWFAY | AATGCCAAGACAAAGCCG |
| | GTGCCCTCCAGCAGCTTGGGCACC | | LEWVSDIYPGSSISNYNEKFKS | WGQGTLVTVSS | CGGGAGGAGCAGTACAAC |
| | CAGACCTACATCTGCAACGTGAAT | | RFTISRDNSKNTLYLQMNSLRA | | AGCACGTACCGTGTGTC |
| | CACAAGCCCAGCAACACCAAGGTG | | EDTAVYYCAREDGYDAWFAYWG | [SEQ ID NO: 393] | AGCCTCTCACCGTCCTG |
| | GACAAGAAGTTGAGCCCAAATCT | | QGTLVTVSSASTKGPSVFPLAP | | CACCAGGACTGGCTGAAT |
| | TGTGACAAAACTCACACATGCCCA | | SSKSTSGGTAALGCLVKDYFPE | | GGCAAGGAGTACAAGTGC |
| | CCGTGCCCAGCACCTGAACTCCTG | | PVTVSWNSGALTSGVHTFPAVL | | AAGGTCTCCAACAAAGCC |
| | GGGGGACCGTCAGTCTTCCTCTTC | | QSSGLYSLSSVVTVPSSSLGTQ | | CTCCAGCCCCCATCGAG |
| | CCCCCAAAACCCAAGGACACCCTC | | TYICNVNHKPSNTKVDKKVEPK | | AAAACCATCTCCAAACCC |
| | ATGATCTCCCGGACCCCTGAGGTC | | SCDKTHTCPPCPAPELLGGPSV | | AAACCGCAGCCCCGAGAA |
| | ACATGCGTGGTGGTGGACGTGAGC | | FLPPKPKDTLMISRTPEVTCV | | CCACAGGTGTACAGCCTG |
| | CACGAAGACCCTGAGGTCAAGTTC | | VDVSHEDPEVKFNWYVDGVEV | | CCCCCATCCCGGGATGAG |
| | AACTGGTACGTGGACGGCGTGGAG | | HNAKTKPREEQYNSTYRVVSVL | | CTGACCAAGAACCAGGTC |
| | GTGCATAATGCCAAGACAAAGCCG | | TVLHQDWLNGKEYKCKVSNKAL | | AGCCTGACCTGCCTGGTC |
| | CGGGAGGAGCAGTACAACAGCACG | | PAPIEKTISKAKGQPREPQVYT | | AAAGGCTTCTATCCCAGC |
| | TACCGTGTGGTCAGCGTCCTCACC | | LPPSRDELTKNQVSLTCLVKGF | | GACATCGCCGTGGAGTGG |
| | GTCCTGCACCAGGACTGGCTGAAT | | YPSDIAVEWESNGQPENNYKTT | | GAGAGCAATGGGCAGCCG |
| | GGCAAGGAGTACAAGTGCAAGGTC | | PPVLDSDGSFFLYSKLTVDKSR | | GAGAACAACTACAAGACC |
| | TCCAACAAAGCCCTCCAGCCCC | | WQQGNVFSCSVMHEALHNHYTQ | | ACGCCTCCGTGCTGGAC |
| | ATCGAGAAAACCATCTCCAAAGCC | | KSLSLSPGK | | TTATATTCAAAGCTCACC |
| | AAAGGGCAGCCCCGAGAACCACAG | | | | GTGGACAAGAGCAGGTGG |
| | GTGTACACCCTGCCCCCATCCCGG | | | | |
| | GATGAGCTGACCAAGAACCAGGTC | | | | |

TABLE 1-continued

| | | |
|---|---|---|
| AGCCTGACCTGCCTGGTCAAAGGC<br>TTCTATCCAGCACATCGCCGTG<br>GAGTGGGAGAGCAATGGGCAGCCG<br>GAGAACAACTACAAGACCACGCCT<br>CCCGTGCTGGACTCCGACGGCTCC<br>TTCTTCTTATATTCAAAGCTCACC<br>GTGGACAAGAGCAGGTGGCAGCAG<br>GGGAACGTCTTCTCATGCTCCGTG<br>ATGCATGAGGCTCTGCACAACCAC<br>TACACGCAGAAGAGCCCTCCCCTG<br>TCTCCGGGAAATGA<br>Without leader [SEQ ID<br>NO: 388]:<br>GAAGTGCAGCTGCTGGAATCTGGC<br>GGCGGACTGGTGCAGCCTGGCGGC<br>TCTCTGAGACTGTCTTGTGCCGCC<br>TCCGGCTACACCTTCACCACCTAC<br>TGGATCACCTGGGTCCGACAGGCT<br>CCCGGCAAGGGACTGGAATGGGTG<br>TCCGACATCTACCCCGGCTCCTCC<br>ATCTCCAACTACAACGAGAAGTTC<br>AAGTCCCGGTTCACCATCTCCGG<br>GACAACACCAAGAACACCCTGTAC<br>CTCCAGATGAACTCCCTGCGGGCC<br>GAGGACACCGCCGTGTACTACTGC<br>GCCAGAGAGGACGGCTACGACGCT<br>TGGTTTGCCTACTGGGGCCAGGGC<br>ACCCTGGTCACCGTGTCATCTGCC<br>TCCACCAAGGGCCCATCCGTCTTC<br>CCCCTGGCACCCTCCTCCAAGAGC<br>ACCTCTGGGGGCACAGCGGCCCTG<br>GGCTGCCTGGTCAAGGACTACTTC<br>CCCGAACCGGTGACGGTGTCGTGG<br>AACTCAGGCGCCCTGACCAGCGGC<br>GTGCACACCTTCCCGGCTGTCCTA<br>CAGTCCTCAGGACTCTACTCCCTC<br>AGCAGCGTCGTGACCGTGCCCTCC<br>AGCAGCTTGGGCACCCAGACCTAC<br>ATCTGCAACGTGAATCACAAGCCC<br>AGCAACACCAAGGTGGACAAGAAA<br>GTTGAGCCCAAATCTTGTGACAAA<br>ACTCACACATGCCCACCGTGCCCA<br>GCACCTGAACTCCTGGGGGGACCG<br>TCAGTCTTCCTCTTCCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG | CAGCAGGGGAACGTCTTC<br>TCATGCTCCGTGATGCAT<br>GAGGCTCTGCACAACCAC<br>TACACGCAGAAGAGCCTC<br>TCCCTGTCTCCGGGAAA<br>TGA<br>(Nucleotides 415<br>to 1401 of SEQ ID<br>NO: 387)<br>[SEQ ID NO: 394]<br>ASTKGPSVFPLAPSSKST<br>SGGTAALGCLVKDYFPEP<br>VTVSWNSGALTSGVHTFP<br>AVLQSSGLYSLSSVVTVP<br>SSSLGTQTYICNVNHKPS<br>NTKVDKKVEPKSCDKTHT<br>CPPCPAPELLGGPSVFLF<br>PPKPKDTLMISRTPEVTC<br>VVVDVSHEDPEVKFNWYV<br>DGVEVHNAKTKPREEQYN<br>STYRVVSVLTVLHQDWLN<br>GKEYKCKVSNKALPAPIE<br>KTISKAKGQPREPQVYTL<br>PPSRDELTKNQVSLTCLV<br>KGFYPSDIAVEWESNGQP<br>ENNYKTTPPVLDSDGSFF<br>LYSKLTVDKSRWQQGNVF<br>SCSVMHEALHNHYTQKSL<br>SLSPGK<br>[SEQ ID NO: 395] |

TABLE 1-continued

| | | | |
|---|---|---|---|
| | TACAAGTGCAAGGTCTCCAACAAA<br>GCCCTCCCAGCCCCATGAGAAA<br>ACCATCTCAAAGCCAAAGGGCAG<br>CCCGAGAACCACAGGTGTACACC<br>CTGCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCTTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGGG<br>AAATGA | | | |
| 7G6-<br>HCzu25 | With leader [SEQ ID NO: 396]:<br>ATGGGCTGGTCCTGCATCATCCTG<br>TTTCTGGTGGCCACCGCCACCGGC<br>GTGCACAGCGAAGTGCAGCTGCTG<br>GAATCTGGCGGCCTCTGAGACTGTGCAG<br>CCTGGCGGCTCTCTGAGACTGTCT<br>TGTGCCGCCTCCGGCTACACCTTC<br>ACCACCTACTGGATCACCTGGGTC<br>CGACAGGCTCCCGGCAAGGGACTG<br>GAATGGGTCTCCGACATCTACCCC<br>GGCTCCTCCATCTCAACTACAAC<br>GAGAAGTTCAAGTCCGGTTCACC<br>ATCTCCGTGACAACTCCAAGAAC<br>ACCCTGTACCTCCAGATGAACTCC<br>CTGAGAGCCGAGGACACCGCCGTG<br>TACTACTGCGCCAGAGAGGACGGC<br>TACGACGTTGGTTTGCTTACTG<br>GGCCAGGGCACCCTGGTCACCGTG<br>TCATCTGCATCCACCAAGGGCCCA<br>TCCGTCTTCCCCCTGGCACCCTCC<br>TCCAAGAGCACCTCTGGGGCACA<br>GCGGCCCTGGGCTGCCTGGTCAAG<br>GACTACTTCCCCGAACCGGTGACG<br>GTGTCGTGGAACTCAGGCGCCCTG<br>ACCAGCGGCGTGCACACCTTCCCG<br>GCTGTCCTACAGTCTCCAGGACTC<br>TACTCCCTCAGCAGCGTGGTGACC<br>GTGCCCTCCAGCAGCTTGGGCACC<br>CAGACCTACATCTGCAACGTGAAT<br>CACAAGCCCAGCAACACCAAGGTG<br>GACAAGAAAGTTGAGCCCAAATCT<br>TGTGACAAAACTCACACATGCCCA<br>CCGTGCCCAGCACCTGAACTCCTG<br>GGGGGACCGTCAGTCTTCCTCTTC | GAAGTGCAGCTGCTGGAA<br>TCTGGCGGCGGACTGGTG<br>CAGCCTGGCGGCTCTCTG<br>AGACTGTCTTGTGCCGCC<br>TCCGGCTACACCTTCACC<br>ACCTACTGGATCACCTGG<br>GTCCGACAGGCTCCCGGC<br>AAGGGACTGGAATGGGTC<br>TCCGACATCTACCCCGGC<br>TCCTCCATCTCCAACTAC<br>AACGAGAAGTTCAAGTCC<br>CGGTTCACCATCTCCGTG<br>GACAACTCCAAGAACACC<br>CTGTACCTCCAGATGAAC<br>TCCCTGAGAGCCGAGGAC<br>ACCGCCGTGTACTACTGC<br>GCCAGAGAGGACGGCTAC<br>GACGTTGGTTTGCTTAC<br>TGGGGCCAGGGCACCCTG<br>GTCACCGTGTCATCT<br>(Nucleotides 58 to<br>414 of SEQ ID NO:<br>396)<br>[SEQ ID NO: 401]<br>EVQLLESGGGLVQPGGSL<br>RLSCAASGYTFTTYWITW<br>VRQAPGKGLEWVSDIYPG<br>SSISNYNEKFKSRFTISV<br>DNSKNTLYLQMNSLRAED<br>TAVYYCAREDGYDAWFAY<br>WGQGTLVTVSS<br>[SEQ ID NO: 402] | GCATCTCACCAAGGGCCCA<br>TCGGTCTTCCCCCTGGCA<br>CCCTCCTCCAAGAGCACC<br>TCTGGGGGCACAGCGGCC<br>CTGGGCTGCCTGGTCAAG<br>GACTACTTCCCCGAACCG<br>GTGACGGTGTCGTGGAAC<br>TCAGGCGCCCTGACCAGC<br>GGCGTGCACACCTTCCCG<br>GCTGTCCTACAGTCTCA<br>GGACTCTACTCCCTCAGC<br>AGCGTGGTGACCGTGCCC<br>TCCAGCAGCTTGGGCACC<br>CAGACCTACATCTGCAAC<br>GTGAATCACAAGCCCAGC<br>AACACCAAGGTGGACAAG<br>AAGTTGAGCCCAAATCT<br>TGTGACAAAACTCACACA<br>TGCCCACCGTGCCCAGCA<br>CCTGAACTCCTGGGGGGA<br>CCGTCAGTCTTCCTCTTC<br>CCCCCAAAACCCAAGGAC<br>ACCCTCATGATCTCCGG<br>ACCCCTGAGGTCACATGC<br>GTGGTGGTGGACGTGAGC<br>CACGAAGACCCCGAGGTC<br>AAGTTCAACTGGTACGTG<br>GACGGCGTGGAGGTGCAT<br>AATGCCAAGACAAGCCG<br>CGGGAGGAGCAGTACAAC<br>AGCACGTACCGTGTGGTC<br>AGCGTCCTCACCGTCCTG<br>CACCAGGACTGGCTGAAT<br>GGCAAGGAGTACAAGTGC<br>AAGGTCTCCAACAAGGCC |

With leader [SEQ ID NO: 398]:
MGWSCIILFLVATATGVHSEVQ
LLESGGGLVQPGGSLRLSCAAS ATGGGCTG
GYTFTTYWITWVRQAPGKGLEW GTCCTGCA
VSDIYPGSSISNYNEKFKSRFT TCATCCTG
ISVDNSKNTLYLQMNSLRAEDT TTTCTGGT
AVYYCAREDGYDAWFAYWGQGT GGCCACCG
LVTVSSASTKGPSVFPLAPSSK CCACCGGC
STSGGTAALGCLVKDYFPEPVT GTGCACAG
VSWNSGALTSGVHTFPAVLQSS C
GLYSLSSVVTVPSSSLGTQTYI (Nucleotides
CNVNHKPSNTKVDKKVEPKSCD 1
KTHTCPPCPAPELLGGPSVFLF to 57 of
PPKPKDTLMISRTPEVTCVVVD SEQ ID
VSHEDPEVKFNWYVDGVEVHNA NO: 396)
KTKPREEQYNSTYRVVSVLTVL [SEQ ID
HQDWLNGKEYKCKVSNKALPAP NO: 400]
IEKTISKAKGQPREPQVYTLPP
SRDELTKNQVSLTCLVKGFYPS
DIAVEWESNGQPENNYKTTPPV
LDSDGSFFLYSKLTVDKSRWQQ
GNVFSCSVMHEALHNHYTQKSL
SLSPGK Without leader [SEQ ID
NO: 399]:
EVQLLESGGGLVQPGGSLRLSC
AASGYTFTTYWITWVRQAPGKG
LEWVSDIYPGSSISNYNEKFKS
RFTISVDNSKNTLYLQMNSLRA
EDTAVYYCAREDGYDAWFAYWG
QGTLVTVSSASTKGPSVFPLAP
SSKSTSGGTAALGCLVHTFPPE
PVTVSWNSGALTSGVHTFPAVL
QSSGLYSLSSVVTVPSSSLGTQ TABLE 1-continued

| | | |
|---|---|---|
| CCCCCAAAACCCAAGGACACCCTC | TYICNVNHKPSNTKVDKKVEPK | CTCCCAGCCCCCATCGAG |
| ATGATCTCCCGGACCCCTGAGGTC | SCDKTHTCPPCPAPELLGGPSV | AAAACCATCTCCAAGGCC |
| ACATGCGTGGTGGTGGACGTGAGC | FLFPPKPKDTLMISRTPEVTCV | AAAGGGCAGCCCCGAGAA |
| CACGAAGACCCTGAGGTCAAGTTC | VVDVSHEDPEVKFNWYDGVEV | CCACAGGTCTACACCCTG |
| AACTGGTACGTGGACGGCGTGGAG | HNAKTKPREEQYNSTYRVVSVL | CCCCCATCCGGGATGAG |
| GTGCATAATGCCAAGACAAAGCCG | TVLHQDWLNGKEYKCKVSNKAL | CTGACCAAGAACCAGGTC |
| CGGGAGGAGCAGTACAACAGCACG | PAPIEKTISKAKGQPREPQVYT | AGCCTGACCTGCCTGGTC |
| TACCGTGTGGTCAGCGTCCTCACC | LPPSRDELTKNQVSLTCLVKGF | AAAGGCTTCTATCCCAGC |
| GTCCTGCACCAGGACTGGCTGAAT | YPSDIAVEWESNGQPENNYKTT | GACATCGCCGTGGAGTGG |
| GGCAAGGAGTACAAGTGCAAGGTC | PPVLDSDGSFFLYSKLTVDKSR | GAGAGCAATGGGCAGCCG |
| TCCAACAAGGCCCTCCCAGCCCCC | WQQGNVFSCSVMHEALHNHYTQ | GAGAACAACTACAAGACA |
| ATCGAGAAAACCATCTCCAAAGCC | KSLSLSPGK | ACGCCTCCCGTGCTGGAC |
| AAAGGGCAGCCCCGAGAACCACAG | | TCCGACGGCTCCTTCTTC |
| GTGTACACCCTGCCCCCATCCCGG | | TTATATTCAAAGCTCACC |
| GATGAGCTGACCAAGAACCAGGTC | | GTGGACAAGAGCAGGTGG |
| AGCCTGACCTGCCTGGTCAAAGGC | | CAGCAGGGGAACGTCTTC |
| TTCTATCCCAGCGACATCGCCGTG | | TCATGCTCCGTGATGCAT |
| GAGTGGGAGAGCAATGGGCAGCCG | | GAGGCTCTGCACAACCAC |
| GAGAACAACTACAAGACCACGCCT | | TACACGCAGAAGAGCCTC |
| CCCGTGCTGGACTCCGACGGCTCC | | TCCCTGTCTCCGGGAAA |
| TTCTTCTTATATTCAAAGCTCACC | | TGA |
| GTGGACAAGAGCAGGTGGCAGCAG | | (Nucleotides 415 |
| GGGAACGTCTTCTCATGCTCCGTG | | to 1401 of SEQ ID |
| ATGCATGAGGCTCTGCACAACCAC | | NO: 396) [SEQ ID |
| TACACGCAGAAGAGCCTCTCCCTG | | NO: 403] |
| TCTCCGGGAAATGA | | ASTKGPSVFPLAPSSKST |
| Without leader [SEQ ID | | SGGTAALGCLVKDYFPEP |
| NO: 397]: | | VTVSWNSGALTSGVHTFP |
| GAAGTGCAGCTGCTGGAATCTGGC | | AVLQSSGLYSLSSVVTVP |
| GGCGGACTGGTGCAGCCTGGCGGC | | SSSLGTQTYICNVNHKPS |
| TCTCTGAGACTGTCTTGTGCCGCC | | NTKVDKKVEPKSCDKTHT |
| TCCGGCTACACCTTCACCACCTAC | | CPPCPAPELLGGPSVFLF |
| TGGATCACCTGGGTCCGACAGGCT | | PPKPKDTLMISRTPEVTC |
| CCCGGCAAGGGACTGGAATGGGTC | | VVVDVSHEDPEVKFNWYV |
| TCCGACATCTACCCCGGCTCTCC | | DGVEVHNAKTKPREEQYN |
| ATCTACAACGAGAAGTTC | | STYRVVSVLTVLHQDWLN |
| AAGTCCCGGGTTCACCATCCGTG | | GKEYKCKVSNKALPAPIE |
| GACAACTCCAAGAACACCCTGTAC | | KTISKAKGQPREPQVYTL |
| CTCCAGATGAACTCCCTGAGAGCC | | PPSRDELTKNQVSLTCLV |
| GAGGACACCGGTGTACTACTGC | | KGFYPSDIAVEWESNGQP |
| GCCAGAGAGGACGGCTACCACGCT | | ENNYKTTPPVLDSDGSFF |
| TGGTTTGCTTACTGGGGCCAGGGC | | LYSKLTVDKSRWQQGNVF |
| ACCCTGGTCACCGTGTCATCTGCA | | SCSVMHEALHNHYTQKSL |
| TCCACCAAGGGCCCATCGGTCTTC | | SLSPGK |
| CCCCTGGCACCCTCCTCCAAGAGC | | [SEQ ID NO: 404] |
| ACCTCTGGGGGCACAGCGGCCCTG | | |
| GGCTGCCTGGTCAAGGACTACTTC | | |
| CCCGAACCGGTGACGGTGTCGTGG | | |
| AACTCAGGCGCCCTGACCAGCGGC | | |
| GTGCACACCTTCCCGGCTGTCCTA | | |
| CAGTCCTCAGGACTCTACTCCCTC | | |
| AGCAGCGTGGTGACCGTGCCCTCC | | |
| AGCAGCTTGGGCACCCAGACCTAC | | |

TABLE 1-continued

| Clone Name (Species & Isotype) | Light Chain DNA Sequence | Light Chain Amino Acid Sequence | cDNA Position Leader | Variable Domain (cDNA) (amino acid) | Constant Domain (cDNA) (amino acid) |
|---|---|---|---|---|---|
| mouse 7G6-Vκ | With leader [SEQ ID NO: 405]:<br>ATGAAGTTGCCTGTTAGGCTGTTG<br>GTGATGATGTTCTGGATTCCTGCT<br>TCCAGCAGTGATGTTTTGATGACC<br>CAAACTCCACTCTCCCTGCCTGTC<br>AGTCTTGGAGATCAAGCCTCCATC<br>TCTTGCAGATCTAGTCAGAGCATT<br>TTACATAGTAATGGAAACACCTAT<br>TTAGAATGGTACCTGCAGAAACCA<br>GGCCAGTCTCCAAAGCTCCTGATT<br>TGCAAAGTTTCCAACCGATTTTCT<br>ATCTGCAACGTGAATCACAAGCCC<br>AGCAACACCAAGTGGACAAGAAA<br>GTTGAGCCCAAATGCCACCGTGCCCA<br>ACTCACACATGCCACCGTGCCCA<br>GCACCTGAACTCCTGGGGGACCG<br>TCAGTCTTCCTCTTCCCCCAAAA<br>CCCAAGGACACCCTCATGATCTCC<br>CGGACCCCTGAGGTCACATGCGTG<br>GTGGTGGACGTGAGCCACGAAGAC<br>CCTGAGGTCAAGTTCAACTGGTAC<br>GTGGACGGCGTGGAGGTGCATAAT<br>GCCAAGACAAAGCCGCGGGAGGAG<br>CAGTACAACAGCACGTACCGTGTG<br>GTCAGCGTCCTCACCGTCCTGCAC<br>CAGGACTGGCTGAATGGCAAGGAG<br>TACAAGTGCAAGGTCTCCAACAAA<br>GCCCTCCCAGCCCCCATCGAGAAA<br>ACCATCTCCAAAGCCAAAGGGCAG<br>CCCCGAGAACCACAGGTGTACACC<br>CTGCCCCCATCCCGGGATGAGCTG<br>ACCAAGAACCAGGTCAGCCTGACC<br>TGCCTGGTCAAAGGCTTCTATCCC<br>AGCGACATCGCCGTGGAGTGGGAG<br>AGCAATGGGCAGCCGGAGAACAAC<br>TACAAGACCACGCCTCCCGTGCTG<br>GACTCCGACGGCTCCTTCTTCCTA<br>TATTCAAAGCTCACCGTGGACAAG<br>AGCAGGTGGCAGCAGGGGAACGTC<br>TTCTCATGCTCCGTGATGCATGAG<br>GCTCTGCACAACCACTACACGCAG<br>AAGAGCCTCTCCCTGTCTCCGG<br>GAAATGA | With leader [SEQ ID NO: 407]:<br>MKLPVRLLVMMFWIPASSSDVL<br>MTQTPLSLPVSLGDQASISCRS<br>SQSILHSNGNTYLEWYLQKPGQ<br>SPKLLICKVSNRFSGVPDRFSG<br>SGSGTDFTLKISRVEAEDLGVY<br>YCFQGSHVPFTFGSGTKLEIKR<br>ADAAPTVSIFPPS<br>Without leader [SEQ ID NO: 408]:<br>DVLMTQTPLSLPVSLGDQASIS | ATGAAGTT<br>GCCTGTTA<br>GGCTGTTG<br>GTGATGAT<br>GTTCTGGA<br>TTCCTGCT<br>TCCAGCAG<br>T<br>(nucleotides 1 to 57 of SEQ ID | GATGTTTTGATGACCCAA<br>ACTCCACTCTCCCTGCCT<br>GTCAGTCTTGGAGATCAA<br>GCCTCCATCTCTTGCAGA<br>TCTAGTCAGAGCATTTTA<br>CATAGTAATGGAAACACC<br>TATTTAGAATGGTACCTG<br>CAGAAACCAGGCCAGTCT<br>CCAAAGCTCCTGATTTGC<br>AAAGTTTCCAACCGATTT<br>TCTGGGGTCCCAGACAGG<br>TTCAGTGGCAGTGGATCA | CGGGCTGATGCTGCACCA<br>ACTGTATCCATCTTCCCA<br>CCTTC<br>(nucleotides 394 to 434 of SEQ ID NO: 405)<br>[SEQ ID NO: 412]<br>KRADAAPTVSIFPPS<br>[SEQ ID NO: 413] |

7G6 VL sequences

TABLE 1-continued

| | | | |
|---|---|---|---|
| | GGGGTCCCAGAGAGGTTCAGTGGC<br>AGTGGATCAGGACAGATTTCACA<br>CTCAAGATCAGCAGAGTGGAGGCT<br>GAGGATCTGGAGTTATTACTGC<br>TTTCAAGGTTCACATGTTCCATTC<br>ACGTTCGGCTCGGGGACAAAGTTG<br>GAAATAAAACGGGCTGATGCTGCA<br>CCAACTGTATCCATTCTCCCACCT<br>TC<br>Without leader [SEQ ID<br>NO: 406]:<br>GATGTTTTGATGACCCAAACTCCA<br>CTCTCCCTGCCTGTCAGTCTTGGA<br>GATCAAGCCTCCATCTCTTGCAGA<br>TCTAGTCAGAGCATTTACATAGT<br>AATGGAAACACCTATTTAGAATGG<br>TACCTGCAGAAACCAGGCCAGTCT<br>CCAAAGCTCCTGATTTCTGGGGTCCA<br>TCCAACCGATTTTCTGGGGTCCA<br>GACAGGTTCAGTGCAGTGGATCA<br>GGGACAGATTTCACACTCAAGATC<br>AGCAGAGTGGAGGCTGAGGATCTG<br>GGAGTTTATTACTGCTTTCAAGGT<br>TCACATGTTCCATTCACGTTCGGC<br>TCGGGGACAAAGTTGGAAATAAAA<br>CGGGCTGATGCTGCACCAACTGTA<br>TCCATCTTCCCACCTTC | CRSSQSILHSNGNTYLEWYLQK<br>PGQSPKLLICKVSNRFSGVPDR<br>FSGSGSGTDFTLKISRVEAEDL<br>GVYYCFQGSHVPFTFGSGTKLE<br>IKRADAAPTVSIFPPS | | GGGACAGATTTCACACTC<br>AAGATCAGCAGAGTGGAG<br>GCTGAGGATCTGGAGTT<br>TATTACTGCTTTCAAGGT<br>TCACATGTTCCATTCACG<br>TTCGGCTCGGGGACAAAG<br>TTGGAAATAAAA<br>(nucleotides 58 to<br>393 of SEQ ID NO:<br>405)<br>[SEQ ID NO: 410]<br>DVLMTQTPLSLPVSLGDQ<br>ASISCRSSQSILHSNGNT<br>YLEWYLQKPGQSPKLLIC<br>KVSNRFSGVPDRFSGSGS<br>GTDFTLKISRVEAEDLGV<br>YYCFQGSHVPFTFGSGTK<br>LEIK<br>[SEQ ID NO: 411] |
| 7G6-<br>LCzu1 | With leader [SEQ ID<br>NO: 414]:<br>ATGGGCTGGTCCTGCATCATCCTG<br>TTTCTGGTGGCCACCGCCACCGGC<br>GTGCACAGCGACGTCGTGATGACA<br>CAGTCCCCCCTGTCCCTGCCTGTG<br>AGCCTGGGACAGCCTGCCTCCATC<br>TCCTGCAGATCCTCCCAGTCCATC<br>CTGCACTCCAACGCCAACACCTAC<br>CTGGAATGGTTCCAGCAGCCGCCT<br>GGCCAGTCTCCCAGACGGCTGATC<br>TACAAGGTGTCCAACCGGTTCTCC<br>GGCGTGCCCGACAGATTCTCCGGC<br>TCTGGCTCTGGCACCGACTTCACC<br>CTGAAGATCTCCCGGGTGGAAGCC<br>GAGGACGTGGGCGTGTACTACTGT<br>TTTCAAGGCTCCCACGTGCCCTTC<br>ACCTTCGGCCAGGGCACCAAGCTG<br>GAAATCAAACGAACTGTGGCTGCA<br>CCATCTGTCTTCATCTTCCCGCCA<br>TCTGATGAGCAGTTGAAATCTGGA<br>ACTGCCTCTGTTGTGTGCCTGCTG<br>AATAACTTCTATCCCAGAGAGGCC<br>AAAGTACAGTGGAAGGTGGATAAC<br>GCCCTCCAATCGGGTAACTCCCAG | With leader [SEQ ID<br>NO: 416]:<br>MGWSCIILFLVATATGVHSDVV<br>MTQSPLSLPVTLGQPASISCRS<br>SQSILHSNGNTYLEWFQQRPGQ<br>SPRRLIYKVSNRFSGVPDRFSG<br>SGSGTDFTLKISRVEAEDVGVY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 417]:<br>DVVMTQSPLSLPVTLGQPASIS<br>CRSSQSILHSNGNTYLEWFQQR<br>PGQSPRRLIYKVSNRFSGVPDR<br>FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA | ATGGGCTG<br>GTCCTGCA<br>TCATCCTG<br>TTTCTGT<br>GGCCACCG<br>CCACCGGC<br>GTGCACAG<br>nucleotide<br>1 to<br>57 of<br>SEQ ID<br>NO: 414)<br>[SEQ ID<br>NO: 418] | GACTGTCGTGATGACACAG<br>TCCCCCCTGTCCCTGCCT<br>GTGACCCTGGGACAGCCT<br>GCCTCCATCTCCTGCAGA<br>TCCTCCCAGTCCATCCTG<br>CACTCCAACGGCAACACC<br>TACCTGGAATGGTTCCAG<br>CAGCGCCTGGCCAGTCT<br>CCCAGACGGCTGATCTAC<br>AAGGTGTCCAACCGGTTC<br>TCCGGCGTGCCCGACAGA<br>TTCTCCGGCTCTGGCTCT<br>GGCACCGACTTCACCCTG<br>AAGATCTCCCGGGTGGAA<br>GCCGAGGACGTGGGCGTG<br>TACTACTGTTTTCAAGGC<br>TCCCACGTGCCCTTCACC<br>TTCGGCCAGGGCACCAAG<br>CTGAAATCAAA<br>(nucleotide 58<br>393 of SEQ ID NO:<br>414)<br>[SEQ ID NO: 419]<br>DVVMTQSPLSLPVTLGQP<br>ASISCRSSQSILHSNGNT | CGAACTGTGGCTGCACCA<br>TCTGTCTTCATCTTCCCG<br>CCATCTGATGAGCAGTTG<br>AAATCTGGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGT<br>(nucleotide 394 to<br>to 714 of SEQ ID NO:<br>414)<br>[SEQ ID NO: 421]<br>RTVAAPSVFIFPPSDEQL<br>KSGTASVVCLLNNFYPRE<br>AKVQWKVDNALQSGNSQE |

TABLE 1-continued

| | | | |
|---|---|---|---|
| | GAGAGTGTCACAGAGCAGGACAGC<br>AAGGACAGCACCTACAGCCTCAGC<br>AGCACCCTGACGCTGAGCAAAGCA<br>GACTACGAGAAACAAAGTCTAC<br>GCCTGCGAAGTCACCCATCAGGGC<br>CTGAGCTCGCCCCTCACAAAGAGC<br>TTCAACAGGGAGAGTGTTGA<br>Without leader [SEQ ID<br>NO: 415]:<br>GACGTCGTGATGACACAGTCCCCC<br>CTGTCCCTGCCTGTGACCCTGGGA<br>CAGCCTGCCTCCATCTCCTGCAGA<br>TCCTCCCAGTCCATCCTGCACTCC<br>AACGGCAACAGCACCTACCTGGAATGG<br>TTCCAGCAGCGGCCTGGCCAGTCT<br>CCCAGACGGCTGATCTACAAGGTG<br>TCCAACCGGTTCTCCGGCGTGCCC<br>GACAGATTCTCACCCTGGCTCT<br>GGCACCGACTTCACCCTGAAGATC<br>TCCCGGGTGGAAGCCGAGGACGTG<br>GGCGTGTACTACTGTTTTCAAGGC<br>TCCCACGTGCCCTTCACCTTCGGC<br>CAGGGCACCAAGCTGGAAATCAAA<br>CGAACTGTGGCTGCACCATCGTC<br>TTCATCTTCCCGCCATCTGATGAG<br>CAGTTGAAATCTGGAACTGCCTCT<br>GTTGTGTGCCTGCTGAATAACTTC<br>TATCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCACCCTG<br>ACGCTGAGCAAAGCAGACTACGAG<br>AAACACAAAGTCTACGCCTGCGAA<br>GTCACCCATCAGGGCCTGAGCTCG<br>CCCGTCACAAAGAGCTTCAACAGG<br>GGAGAGTGTTGA | CEVTHQGLSSPVTKSFNRGEC | YLEWFQQRPGQSPRRLIY<br>KVSNRFSGVPDRFSGSGS<br>GTDFTLKISRVEAEDVGV<br>YYCFQGSHVPFTFGQGTK<br>LEIK<br>[SEQ ID NO: 420] | SVTEQDSKDSTYSLSSTL<br>TLSKADYEKHKVYACEVT<br>HQGLSSPVTKSFNRGEC<br>[SEQ ID NO: 422] |
| 7G6-<br>LCzu2 | With leader [SEQ ID NO:<br>423]:<br>ATGGGCTGGTCCTGCATCATCCTG<br>TTTCTGGTGGCCACCGCCACCGGC<br>GTGCACAGCCAGTCGATGACA<br>CAGTCCCCCCTGTCCCTGCCTGTG<br>ACCCTGGGACAGCCTGCCTCCATC<br>TCCTGCAGATCCTCCCAGTCCATC<br>CTGCACTCCAACGGCAACAACCTAC<br>CTGGAATGGTATCAACAGCGGCCT<br>GGCCAGTCTCCCAGACTGCTGATC<br>TGCAAGGTGTCCAACCGGTTCTCC<br>GGCGTGCCCGACAGATTCTCCGGC<br>TCTGGCTCCGGCACCGACTTCACC<br>CTGAAGATCTCCCGGGTGGAAGCC | With leader [SEQ ID<br>NO: 425]:<br>MGWSCIILFLVATATGVHSDVV<br>MTQSPLSLPVTLGQPASISCRS<br>SQSILHSNGNTYLEWYQQRPGQ<br>SPRLLICKVSNRFSGVPDRFSG<br>SGSGTDFTLKISRVEAEDVGVY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 426]: | ATGGGCTG<br>GTCCTGCA<br>TCATCCTG<br>TTTCTGGT<br>GGCCACCG<br>CCACCGGC<br>GTGCACAG<br>C<br>(Nucleotides<br>1<br>to 57 of<br>SEQ ID<br>NO:<br>423)<br>[SEQ ID | CGAACTGTGGCTGCACCA<br>TCGTCTTCATCTTCCCG<br>CCATCTGATGAGCAGTTG<br>AAATCTGGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACAAAGTC<br>TACGCCTGCGAAGTCACC |

TABLE 1-continued

| | | | |
|---|---|---|---|
| | GAGGACGTGGGCGTGTACTACTGT<br>TTTCAAGGCTCCCACGTGCCCTTC<br>ACCTTCGGCCAGGGCACCAAGCTG<br>GAAATCAAACGAACTGTGGCTGCA<br>CCATCTGTCTTCATCTTCCCGCCA<br>TCTGATGAGCAGTTGAAATCTGGA<br>ACTGCCTCTGTTGTGCCTGCTG<br>AATAACTTCTATCCCAGAGAGGCC<br>AAAGTACAGTGGAAGGTGATAAC<br>GCCCTCCAATCGGGTAACTCCCAG<br>GAGAGTGTCACAGAGCAGGAC<br>AAGGACAGCACCTACAGCCTCAGC<br>AGCACCCTGACGCTGAGCAAAGCA<br>GACTACGAGAAACACAAAGTCTAC<br>GCCTGCGAAGTCACCCATCAGGGC<br>CTGAGCTCCCCGTCACAAAGAGC<br>TTCAACAGGGGAGAGTGTTGA<br>Without leader [SEQ ID<br>NO: 424]:<br>GACCTCGTGATGACACAGTCCCCC<br>CTGTCCCTGCCTGTGACCCTGGGA<br>CAGCCTGCCTCCATCTCCTGCAGA<br>TCCTCCCAGTCCCATCCTGCACTCC<br>AACGGCAACACTTACCTGGAATGG<br>TATCAGCAGCGGCCCTGCCAGTCT<br>CCCAAGCTGCTGATCTGCAAGGTG<br>TCCAACCGGTTCTCCGGCGTGCCC<br>GACAGATTCTCCGGCTCTGGCTCT<br>GGCACCGACTTCACCCTGAAGATC<br>TCCCGGGTGAAGCCGAGGACGTG<br>GGCGTGTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGGAACTGCCTCT<br>GTTGTGTGCCTGCTGAATAACTTC<br>TATCCCAGAGAGGCCAAAGTACAG<br>TGGAAGGTGATAACGCCCTCCAA<br>TCGGGTAACTCCCAGGAGAGTGTC<br>ACAGAGCAGGACAGCAAGGACAGC<br>ACCTACAGCCTCAGCAGCACCCTG<br>ACGCTGAGCAAAGCAGACTACGAG<br>AAACACAAAGTCTACGCCTGCGAA<br>GTCACCCATCAGGGCCTGAGCTCG<br>CCCGTCACAAAGAGCTTCAACAGG<br>GGAGAGTGTTGA | DVVMTQSPLSLPVTLGQPASIS<br>CRSSQSILHSNGNTYLEWYQQR<br>PGQSPRLLICKVSNRFSGVPDR<br>FSGSGSTDFTLKISRVEAEDVG<br>VYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC<br>[SEQ ID NO: 427] | TACTACTGTTTTCAAGGC<br>TCCCACGTGCCCTTCACC<br>TTCGGCCAGGGCACCAAG<br>CTGGAAATCAAA<br>(Nucleotides 58 to<br>393 of SEQ ID NO:<br>423)<br>[SEQ ID NO: 428]<br>DVVMTQSPLSLPVTLGQP<br>ASISCRSSQSILHSNGNT<br>YLEWYQQRPGQSPRLLIC<br>KVSNRFSGVPDRFSGSGS<br>GTDFTLKISRVEAEDVGV<br>YYCFQGSHVPFTFGQGTK<br>LEIK<br>[SEQ ID NO: 429] | CATCAGGGCCTGAGCTCG<br>CCCGTCACAAAGAGCTTC<br>AACAGGGGAGAGTGT<br>(Nucleotides 394<br>to 714 of SEQ ID<br>NO: 423)<br>[SEQ ID NO: 430]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 431] |
| 7G6-<br>LCzu3 | With leader [SEQ ID NO:<br>432]:<br>ATGGGCTGGTCCTGCATCATCCTG<br>TTTCTGGTGGCCACCGCCACCGGC<br>GTGCACAGCGACGTCGTGATGACA | With leader [SEQ ID<br>NO: 434]:<br>MGWSCIILFLVATATGVHSDVV<br>MTQSPLSLPVTLGQPASISCRS<br>SQSILHSNGNTYLEWFQQRPGQ | ATGGGCTG<br>GTCCTGCA<br>TTTCTGGT<br>GGCCACCG | GACGTCGTGATGACACAG<br>TCCCCCCTCTCCCTGCCT<br>GTGACCCTGGGACAGCCT<br>GCCTCCATCTCCTGCAGA<br>TCCTCCCAGTCCCATCCTG | CGAACTGTGGCTGCACCA<br>TCTGTCTTCATCTTCCCG<br>CCATCTGATGAGCAGTTG<br>AAATCTGGAACTGCCTCT<br>GTTGTGTGCCTGCTGAAT |

TABLE 1-continued

| | | |
|---|---|---|
| CAGTCCCCCCCTGTCCCTGCCTGTG | SPRRLICKVSNRFSGVPDRFSG | CCACCGGC | CACTCCAACGGCACACC | AACTTCTATCCCAGAGAG |
| ACCCTGGACAGCCTGCCTCCATC | SGSGTDFTLKISRVEAEDVGVY | GTGCACAG | TACCTGAATGGTTCCAG | GCCAAAGTACAGTGGAAG |
| TCCTGCAGATCCTCCAGTCCATC | YCFQGSHVPFTFGQGTKLEIKR | C | CAGCCCCTCTGCCACTCT | GTGGATAACGCCCTCCAA |
| CTGCACTCCAACGGCAACACCTAC | TVAAPSVFIFPPSDEQLKSGTA | (nucleotides | CCCCGTAGACTGATCTGC | TCGGGTAACTCCCAGGAG |
| GGGCCAGTCTCCCCGACTGATC | SVVCLLNNFYPREAKVQMKVDN | 1 | AAGGTGTCCAACCGGTTC | AGTGTCACAGAGCAGGAC |
| GGCCAGTGTCCAACCGGTCTCC | ALQSGNSQESVTEQDSKDSTYS | to 57 of | TCCGGCGTGCCCGACAGA | AGCAAGGACCAGCACCTAC |
| TGCAAGGTGCCCGACAGATTCTCCGGC | LSSTLTLSKADYEKHKVYACEV | SEQ ID | TTCTCCGGCTCTGGCTCT | AGCCTCAGCAGCACCCTG |
| GGCGTGCCCGACAGATTCTCCGGC | THQGLSSPVTKSFNRGEC | NO: 432) | GGCACCGACTTCACCCTG | ACGCTGAGCAAAGCAGAC |
| TCTGGCTCTGGCACCGACTTCACC | Without leader [SEQ ID | [SEQ ID | AAGATCTCCCGGGTGGAA | TACGAGAAACACAAAGTC |
| CTGAAGATCTCCCGGGTGGAAGCC | NO: 435]: | NO: 436] | GCCGAGGACGTGGGCGTG | TACGCCTGCGAAGTCACC |
| GAGGACGTGGGCGTGTACTACTGT | DVVMTQSPLSLPVTLGQPASIS | | TACTACTGTTTTCAACCC | CATCAGGGCTGAGCTCG |
| TTTCAAGGCTCCCACGTGCCCTTC | CRSSQSILHSNGNTYLEWFQQR | | TCCCACGTGCCCTTCACC | CCCGTCACAAAGAGCTTC |
| ACCTTCGGCCAGGGCACCAAGCTG | PGQSPRRLICKVSNRFSGVPDR | | TTCGGCCAGGGCACCAAG | AACAGGGGAGAGTGT |
| GAAATCAAACAGCTGTGCGTGCA | FSGSGSGTDFTLKISRVEAEDV | | CTGGAAATCAAA | (nucleotides 394 |
| CCATCTGTCTTCATCTTCCCGCCA | GVYYCFQGSHVPFTFGQGTKLE | | (nucleotides 58 to | to 714 of SEQ ID |
| TCTGATGAGCAGTTGAAATCTGGA | IKRTVAAPSVFIFPPSDEQLKS | | 393 of SEQ ID NO: | NO: 432) |
| ACTGCCTCTGTTGTGTGCCTGCTG | GTASVVCLLNNFYPREAKVQWK | | 432) | [SEQ ID NO: 439] |
| AATAACTTCTATCCCAGAGAGGCC | VDNALQSGNSQESVTEQDSKDS | | [SEQ ID NO: 437] | RTVAAPSVFIFPPSDEQL |
| AAAGTACAGTGGAAGGTGGATAAC | TYSLSSTLTLSKADYEKHKVYA | | DVVMTQSPLSLPVTLGQP | KSGTASVVCLLNNFYPRE |
| GCCCTCCAATCGGGTAACTCCCAG | CEVTHQGLSSPVTKSFNRGEC | | ASISCRSSQSILHSNGNT | AKVQWKVDNALQSGNSQE |
| GAGAGTGTCACAGAGCAGGACAGC | | | YLEWFQQRPGQSPRRLIC | SVTEQDSKDSTYSLSSTL |
| AAGGACAGCACCTACAGCCTCAGC | | | KVSNRFSGVPDRFSGSGS | TLSKADYEKHKVYACEVT |
| AGCACCCTGACGCTGAGCAAAGCA | | | GTDFTLKISRVEAEDVGV | HQGLSSPVTKSFNRGEC |
| GACTACGAGAAACACAAAGTCTAC | | | YYCFQGSHVPFTFGQGTK | [SEQ ID NO: 440] |
| GCCTGCGAAGTCACCCATCAGGGC | | | LEIK | |
| CTGAGCTCGCCCGTCACAAAGAGC | | | [SEQ ID NO: 438] | |
| TTCAACAGGGGAGAGTGTTGA | | | | |
| Without leader [SEQ ID | | | | |
| NO: 433]: | | | | |
| GACGTCGTGATGACACAGTCCCCC | | | | |
| CTGTCCCTGCCTGTGACCCTGGGA | | | | |
| CAGCCTGCCTCCATCTCCTGCAGA | | | | |
| TCCTCCCAGTCCATCCTGCACTCC | | | | |
| AACGGCAACACCTACCTGGAATGG | | | | |
| TTCCAGCAGCGGCCTGGCCAGTCT | | | | |
| CCCCGTAGACTGATCTGCAAGGTG | | | | |
| TCCAACCGGTTCTCCGGCGTGCCC | | | | |
| GACAGATTCTCCGGCTCTGGCTCT | | | | |
| GGCACCGACTTCACCCTGAAGATC | | | | |
| TCCCGGGTGGAAGCCGAGGACGTG | | | | |
| GGCGTGTACTACTGTTTTCAAGGC | | | | |
| TCCCACGTGCCCTTCACCTTCGGC | | | | |
| CAGGGCACCAAGCTGGAAATCAAA | | | | |
| CGAACTGTGGCTGCACCATCTGTC | | | | |
| TTCATCTTCCCGCCATCTGATGAG | | | | |
| CAGTTGAAATCTGGAACTGCCTCT | | | | |
| GTTGTGTGCCTGCTGAATAACTTC | | | | |
| TATCCCAGAGAGGCCAAAGTACAG | | | | |
| TGGAAGGTGGATAACGCCCTCCAA | | | | |
| TCGGGTAACTCCCAGGAGAGTGTC | | | | |
| ACAGAGCAGGACAGCAAGGACAGC | | | | |
| ACCTACAGCCTCAGCAGCACCCTG | | | | |
| ACGCTGAGCAAAGCAGACTACGAG | | | | |

TABLE 1-continued

| 7G6-LCzu4 | With leader [SEQ ID NO: 441]:<br>ATGGGCTGTCCTGCTGCATCATCCTG<br>TTTCTGGTGGCCACCGCCGACCGGC<br>GTGCACAGCGACGTCGTGATGACA<br>CAGTCCCCCGTCCTGTCCCTGTG<br>ACCCTGGGACAGCCTGCCTCCATC<br>TCTGCAGATCCTCCAACGGCAACACCTAC<br>CTGGAATGGTATCAGCAGCCCT<br>GGCCAGTCCCCCAGACGGCTGATC<br>TGCAAGGTGTCCAACCGGTTCTCT<br>GGCGTGCCCGACAGATTCTCCGGC<br>TCTGGCTCGGCACCGACTTCACC<br>CTGAAGATCTCCCGGGTGGAAGCC<br>GAGGACGTGGGCGTGTATACTGT<br>TTTCAAGGCTCCCACGTGCCCTTC<br>ACCTTCGGCCAGGGCACCAAGCTG<br>GAAATCAAACGAACTGTGCCTGCA<br>CCATCTGTCTTCATCTTCCCGCA<br>TCTGATGAGCAGTTGAAATCTGGA<br>ACTGCCTCTGTTGTGCCTGCTG<br>AATAACTTCTATCCCAGAGAGGCC<br>AAAGTACAGTGGAAGTGGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACGCTGAGCAAAGCA<br>GACTACGAGAAACACAAAGTCTAC<br>GCCTGCGAAGTCACCCATCAGGGC<br>CTGAGCTCGCCCGTCACAAAGAGC<br>TTCAACAGGGGAGAGTGTTGA<br>Without leader [SEQ ID NO: 442]:<br>GACGTCGTGATGACACAGTCCCCC<br>CTGTCCCTGCCTGTGACCCTGGGA<br>CAGCCTGCCTCCATCTCTGCAGA<br>TCCTCCCAGTCCATCCTGCACTCC<br>AACGGCAACACCTACCTGGAATGG<br>TATCAGCAGCCTGGCCAGTCC<br>CCAGACGGCTGATCTGCAAGGTG<br>TCCAACCGGTTCTCTGGCGTGCCC<br>GACAGATTCTCCGGCTCTGGCTCT<br>GGCACCGACTTCACCCTGAAGATC<br>TCCCGGGTGGAAGCCGAGGACGTG<br>GGCGTGTACTGTTTCAAGGC<br>TCCCACGTGCCCTTCACCTTCGGC<br>CAGGGCACCAAGCTGGAAATCAAA | With leader [SEQ ID NO: 443]:<br>MGWSCIILFLVATATGVHSDVV<br>MTQSPLSLPVTLGQPASISCRS<br>SQSILHSNGNTYLEWYQQRPGQ<br>SPRRLICKVSNRFSGVPDRFSG<br>SGSGTDFTLKISRVEAEDVGVY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID NO: 444]:<br>DVVMTQSPLSLPVTLGQPASIS<br>CRSSQSILHSNGNTYLEWYQQR<br>PGQSPRRLICKVSNRFSGVPDR<br>FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC<br>(nucleotides 1 to 57 of SEQ ID NO: 441)<br>[SEQ ID NO: 445] | GACTCGTGATGACACAG<br>TCCCCCTGTCCCTGCCT<br>GTGACCCTGGGACAGCCT<br>GCCTCCATCTCTGCAGA<br>TCCTCCCAGTCCATCCTG<br>CACTCCAACGGCAACACC<br>TACCTGGAATGGTATCAG<br>CAGCGGCCTGGCCAGTCC<br>CCAGACGGCTGATCTGC<br>AAGGTGTCCAACCGGTTC<br>TCTGGCGTGCCCGACAGA<br>TTCTCCGGCTCTGGCTCT<br>GGCACCGACTTCACCCTG<br>AAGATCTCCCGGGTGGAA<br>GCCGAGGACGTGGGCGTG<br>TACTACTGTTTTCAAGGC<br>TCCCACGTGCCCTTCACC<br>TTCGGCCAGGGCACCAAG<br>CTGGAAATCAAA<br>(nucleotides 58 to 393 of SEQ ID NO: 441)<br>[SEQ ID NO: 446]<br>DVVMTQSPLSLPVTLGQP<br>ASISCRSSQSILHSNGNT<br>YLEWYQQRPGQSPRRLIC<br>KVSNRFSGVPDRFSGSGS<br>GTDFTLKISRVEAEDVGV<br>YYCFQGSHVPFTFGQGTK<br>LEIK<br>[SEQ ID NO: 447] | CGAACTGTGCTGCACCA<br>TCTGTCTTCATCTTCCCG<br>CCATCTGATGAGCAGTTG<br>AAATCTGGAACTGCCTCT<br>GTTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGT<br>(nucleotides 394 to 714 of SEQ ID NO: 441)<br>[SEQ ID NO: 448]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 449] |

TABLE 1-continued

| | | | |
|---|---|---|---|
| | | CGAACTGTGGCTGCACCATCTGTC<br>TTCATCTTCCCGCCATCTGATGAG<br>CAGTTGAAATCTGCTGAATAACTTC<br>GTTGTGTGCCTGCTGAATAACTTC<br>TATCCAGAGAGGCCAAAGTACAG<br>TGGAAGGTGGATAACGCCCTCCAA<br>TCGGGTAACTCAGGACAGGAGTGTC<br>ACAGAGCAGGACAGCAAGCAGC<br>ACCTACAGCCTCAGCAGCACCTG<br>ACGCTGAGCAAAGTCTACGCTGCGAA<br>AAACACAAAGTCACCCATCAGGGCCTGAGCTCG<br>CCCGTCACAAAGAGCTTCAACAGG<br>GGAGAGTGTTGA | | |
| 7G6-<br>LCzu5 | With leader [SEQ ID NO:<br>450]:<br>ATGGGCTGGTCCTGCATCATCCTG<br>TTTCTGGTGGCCACACGCCACCGGC<br>GTGCACAGCGACGTCGTGATGACA<br>CAGTCCCCCCTGTCCCTGCCTGTG<br>ACCCTGGGACAGCCTGCCTCCATC<br>TCCTGCAGATCTCCCAGTCCATC<br>CTGCACTCCAACGGCAACACCTAC<br>CTGGAATGGTTCAGCAGCTGATC<br>GGCAGTCCCCCAGACTGCTGATC<br>TGCAAGGTGTCCAACCGGTTCTCC<br>GGCTCCGGCGACAGATTCTCCGGC<br>TCTGGCTCTGGCACCGACTTCACC<br>CTGAAGATCTCCCGGGTGGAAGCC<br>GAGGACGTGGCTGTATACTGT<br>TTTCAAGGCTCCCACGTGCCCTC<br>ACCTTCGGCCAGGGCACCAAGCTG<br>GAAATCAAACGAACTGTGGCTGCA<br>CCATCTGTCTTCATCTTCCCGCCA<br>TCTGATGAGCAGTTGAAATCTGGA<br>ACTGCCTCTGTTGTGTGCCTGCTG<br>AATAACTTCTATCCCAGAGAGGCC<br>AAAGTACAGTGGAAGGTGGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACGCTGAGCAAAGCA<br>GACTACGAGAAACAAAGTCTAC<br>GCCTGCGAAGTCACCCATCAGGGC<br>CTGAGCTCGCCCGTCACAAAGAGC<br>TTCAACAGGGGAGAGTGTTGA<br>Without leader [SEQ ID<br>NO: 451]:<br>GACGTCGTGATGACACAGTCCCCC<br>CTGTCCCTGCCTGTGACCCTGGGA<br>CAGCCTGCCTCCATCTCCTGCAGA<br>TCCTCCCAGTCCATCCTGCACTCC | With leader [SEQ ID<br>NO: 452]:<br>ATGGGCTG<br>GTCCTGCA<br>TCATCCTG<br>TTTCTGGT<br>GGCCACCG<br>GCCACCGGC<br>GTGCACAG<br>C<br>(nucleotides<br>1<br>to 57 of<br>SEQ ID<br>NO: 454)<br>Without leader [SEQ ID<br>NO: 453]:<br>DVVMTQSPLSLPVTLGQPASIS<br>CRSSQSILHSNGNTYLEWFQQR<br>PGQSPRLLICKVSNRFSGVPDR<br>FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | GACGTCGTGATGACACAG<br>TCCCCCCTGTCCCTGCCT<br>GTGACCCTGGGACAGCCT<br>GCCTCCATCTCCTGCAGA<br>TCCTCCCAGTCCATCCTG<br>CACTCCAACGGCAACACC<br>TACCTGGAATGGTTCCAG<br>CAGCGCCTGGCCAGTCC<br>CCCAGACTGCTGATCTGC<br>AAGGTGTCCAACCGGTTC<br>TCCGGCGTGCCCGACAGA<br>TTCTCCGGCTCTGGCTCT<br>GGCACCGACTTCACCCTG<br>AAGATCTCCCGGGTGGAA<br>GCCGAGGACGTGGGCGTG<br>TACTACTGTTTTCAAGGC<br>TCCCACGTGCCCTTCACC<br>TTCGGCCAGGGCACCAAG<br>CTGGAAATCAAA<br>(nucleotides 58 to<br>393 of SEQ ID NO:<br>450)<br>[SEQ ID NO: 455]<br>DVVMTQSPLSLPVTLGQP<br>ASISCRSSQSILHSNGNT<br>YLEWFQQRPGQSPRLLIC<br>KVSNRFSGVPDRFSGSGS<br>GTDFTLKISRVEAEDVGV<br>YYCFQGSHVPFTFGQGTK<br>LEIK<br>[SEQ ID NO: 456] | CGAACTGTGGCTGCACCA<br>TCTGTCTTCATCTTCCCG<br>CCATCTGATGAGCAGTTG<br>AAATCTGGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGT<br>(nucleotides 394<br>to 714 of SEQ ID<br>NO: 450)<br>[SEQ ID NO: 457]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 458] |

TABLE 1-continued

| | | | |
|---|---|---|---|
| | AACGGCAACACCTACCTGGAATG<br>TTCCAGCAGCGGCCTGGCCAGTCC<br>CCCAGACTGCTGATCTGCAAGGTG<br>TCCAACCGGTTCTCCGGCGTGCCC<br>GACAGATTCTCCGGCTCTGGCTCT<br>GGCACCGACTTCACCCTGAAGATC<br>TCCCGGGTGGAAGCCGAGGACGTG<br>GGCGTGTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCACCCTG<br>ACGCTGAGCAAAGCAGACTACGAG<br>AAACACAAAGTCTACGCCTGCGAA<br>GTCACCCATCAGGGCCTGAGCTCG<br>CCCGTCACAAAGAGCTTCAACAGG<br>GGAGAGTGTTGA | | |
| 7G6-<br>LCzu6 | With leader [SEQ ID NO:<br>459]:<br>ATGGGCTGGTCCTGCATCATCCTG<br>TTTCTGGTGGCCACCGCCACCGGC<br>GTGCACAGCGACGTCGTGATGACA<br>CAGTCCCCCAGTCTGTCCCTGTG<br>ACCCTGGGACAGCCTGCCTCCATC<br>TCCTGCAGATCCTCCCAGTCCATC<br>CTGCACTCCAACGGCAACACCTAC<br>CTGGAATGGTATCAGCAGCGGCCT<br>GGCCAGTCTCCCCGGCTCCTGATT<br>TCCAAGGTGTCCAACCGGTTCTCC<br>GGCGTGCCCGACAGATTCTCCGGC<br>TCTGGCTCTGGCACCGACTTCACC<br>CTGAAGATCTCCCGGGTGGAAGCC<br>GAGGACGTGGGCGTGTACTACTGT<br>TTTCAAGGCTCCCACGTGCCCTTC<br>ACCTTCGGCCAGGGCACCAAGCTG<br>GAAATCAAACGAACTGTGGCTGCA<br>CCATCTGTCTTCATCTTCCCGCCA<br>TCTGATGAGCAGTTGAAATCTGGA<br>ACTGCTTCTGTTGTGTGCCTGCTG<br>AATAACTTCTATCCCAGAGAGGCC<br>AAAGTACAGTGGAAGGTGGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACGCTGAGCAAAGCA | GACTACGAGAAACACAAAGTCTAC<br>GCCTGCGAAGTCACCCATCAGGGC<br>CTGAGCTCGCCCGTCACAAAGAGC<br>TTCAACAGGGGAGAGTGT<br>(nucleotides 58 to<br>714 of SEQ ID<br>NO: 459)<br>[SEQ ID NO: 466]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC | |
| | With leader [SEQ ID<br>NO: 461]:<br>MGWSCIILFLVATATGVHSDVV<br>MTQSPLSLPVTLGQPASISCRS<br>SQSILHSNGNTYLEWYQQRPGQ<br>SPRLLISKVSNRFSGVPDRFSG<br>SGSGTDFTLKISRVEAEDVGVY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 462]<br>DVVMTQSPLSLPVTLGQPASIS<br>CRSSQSILHSNGNTYLEWYQQR<br>PGQSPRLLISKVSNRFSGVPDR<br>FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | ATGGGCTG<br>GTCCTGCA<br>TCATCCTG<br>TTTCTGGT<br>GGCCACCG<br>CCACCGGC<br>GTGCACAG<br>C<br>(nucleotides<br>1<br>to 57 oF<br>SEQ ID<br>NO: 459)<br>[SEQ ID<br>NO: 463] | |

TABLE 1-continued

| | | | |
|---|---|---|---|
| | GACTACGAGAAACACAAAGTCTAC<br>GCCTGGGAAGTCACCATCAGGGC<br>CTGAGCTCCCCGTCACAAAGAGC<br>TTCAACAGGGGAGAGTGTTGA<br>Without leader [SEQ ID<br>NO: 460]:<br>GACGTCGTGATGACACAGTCCCC<br>CTGTCCCTGCCTGTGACCCTGGA<br>CAGCCTGCCTCCATCTCCTGCAGA<br>TCCTCCCAGTCCATCCTGCACTCC<br>AACGGCAACACCTACCTGGAATG<br>TATCAGCAGCGCCTGGCCAGTCT<br>CCCCGGCTGCTGATTTCCAAGGTG<br>TCCAACCGGTTCTCCGGCGTGCCC<br>GACAGATTCTCCGGCTCTGGCTCT<br>GGCACCGACTTCACCCTGAAGATC<br>TCCCGGGTGGAAGCCGAGGACGTG<br>GGCGTGTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCCAGGAGTGTC<br>ACAGAGCAGGACAGCAAGACAGC<br>ACCTACAGCCTCAGCAGCACCCTG<br>ACGCTGAGCAAAGCAGACTACGAG<br>AAACACAAAGTTACGCCTGCGAA<br>GTCACCCATCAGGGCCTGAGCTCG<br>CCCGTCACAAAGAGCTTCAACAGG<br>GGAGAGTGTTGA | | YYCFQGSHVPFTFGQGTK<br>LEIK<br>[SEQ ID NO: 465] | [SEQ ID NO: 467] |
| 7G6-<br>LCzu7 | With leader [SEQ ID NO:<br>468]:<br>ATGGGATGGTCCTGCATCATCCTG<br>TTTCTGGTGGCCACCGCCACCGGC<br>GTGCACAGCGACGTCGTGATGACA<br>CAGTCCCCCCTGTCCCTGCCTGTG<br>ACCCTGGACAGCCTGCCTCCATC<br>TCCTGCAGATCCTCCCAGTCCATC<br>CTGCACAACGGCAACACCTAC<br>CTGGAATGTTCCAGCAGCGGCCT<br>GGCCAGTCTCCCAGACGGCTGATC<br>TCCAAGGTGTCCAACCGGTTCTCC<br>GGCTCTGGCACCGACTTCACCCTG<br>AAGATCTCCCGGGTGGAAGCC<br>GAGGACGTGGGCGTGTACTACTGT<br>TTTCAAGGCTCCCACGTGCCCTTC<br>ACCTTCGGCCAGGGCACCAAGCTG | ATGGGGCTG<br>GTCCTGCA<br>TCATCCTG<br>TTTCTGGT<br>GGCCACCG<br>CCACCGGC<br>GTGCACAG<br>C<br>(nucleotides<br>1 to 57 of<br>SEQ ID<br>NO: 468)<br>[SEQ ID<br>NO: 472] | With leader [SEQ ID<br>NO: 470]:<br>MGWSCIILFLVATATGVHSDVV<br>MTQSPLSLPVTLGQPASISCRS<br>SQSILHSNGNTYLEWFQQRPGQ<br>SPRRLISKVSNRFSGVPDRFSG<br>SGSGTDFTLKISRVEAEDVGVY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 471]:<br>DVVMTQSPLSLPVTLGQPASIS<br>CRSSQSILHSNGNTYLEWFQQR<br>PGQSPRRLISKVSNRFSGVPDR | GACGTCGTGATGACACAG<br>TCCCCCCTGTCCCTGCCT<br>GTGACCCTGGACAGCCT<br>GCCTCCATCTCCTGCAGA<br>TCCTCCCAGTCCATCCTG<br>CACTCCAACGGCAACACC<br>TACCTGGAATGGTTCCAG<br>CAGCGGCCTGGCCAGTCT<br>CCCAGACGGCTGATCTCC<br>AAGGTGTCCAACCGGTTC<br>TCCGGCTCTGGCACCGAC<br>TTCACCCTGAAGATCTCC<br>CGGGTGGAAGCC<br>GAGGACGTGGGCGTG<br>TACTACTGTTTTCAAGGC<br>TCCCACGTGCCCTTCACC<br>TTCGGCCAGGGCACCAAG | CGAACTGTGGCTGCACCA<br>TCTGTCTTCATCTTCCCG<br>CCATCTGATGAGCAGTTG<br>AAATCTGGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGT |

TABLE 1-continued

| | | | |
|---|---|---|---|
| | GAAATCAAACGAACTGTGGCTGCA<br>CCATCTGTCTTCATCTCCCGCCA<br>TCTGATGAGCAGTTGAAATCTGGA<br>ACTGCCTCTGTTGTGTGCCTGCTG<br>AATAACTTCTATCCAGAGGAGGCC<br>AAAGTACAGTGGAAGGTGGATAAC<br>GCCCTGCCAATCGGGTAACTCCAG<br>GAGAGTGTCACAGAGCAGGACAGC<br>AAGGACAGCAGCTACAGCCTCAGC<br>AGCACCCTGACCCTGAGCAAAGCA<br>GACTACGAGAAACACAAAGTCTAC<br>GCCTGCGAAGTCACCCATCAGGGC<br>CTGAGCTCGCCCCGTCACAAAGAGC<br>TTCAACAGGGGAGAGTGTTGA<br>Without leader [SEQ ID<br>NO: 469]:<br>GACGTCGTGATGACACAGTCCCCC<br>CTGTCCCCTGTCCCTGACCCTGGGA<br>CAGCCTGCCTCCATCTCCTGCAGA<br>TCCTCCCAGTCCATCGTCCACTCC<br>AACGGCAACACACTTACCTGGAATGG<br>TTCAGCAGCGCCCTGGCCAGTCT<br>CCCAGAGCGGCTGATCTCCAAGGTG<br>TCCAACCGGTTCTCCGGCCGTGCCC<br>GACAGATTCTCCGGCTCTGGCTCT<br>GGCACCGACTTCACCCTGAAGATC<br>TCCCGGGTGGAAGCCGAGGACGTG<br>GGCGTGTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGGCTGCTGAATAACTTC<br>TATCCAGAGAGGCCAAAGTACAG<br>TGGAAGGTGGATAACGCCCTCCAA<br>TCGGGTAACTCCAGGAGAGTGTC<br>ACAGAGCAGGACAGCAGGACAGC<br>ACCTACAGCCTCAGCAGCACCTG<br>ACCCTGAGCAAAGCAGACTACGAG<br>AAACACAAAGTCTACGCCTGCGAA<br>GTCACCCATCAGGGCCTGAGCTCG<br>CCCGTCACAAAGAGCTTCAACAGG<br>GGAGAGTGTTGA | FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | CTGAAATCAAA<br>(nucleotides 58 to<br>393 of SEQ ID NO:<br>468)<br>[SEQ ID NO: 473]<br>DVVMTQSPLSLPVTLGQP<br>ASISCRSSQSIHSNGNT<br>YLEWFQQRPGQSPRRLIS<br>KVSNRFSGVPDRFSGSGS<br>GTDFTLKISRVEAEDVGV<br>YYCFQGSHVPFTFGQGTK<br>LEIK<br>[SEQ ID NO: 474] | (nucleotides 394<br>to 714 of SEQ ID<br>NO: 468)<br>[SEQ ID NO: 475]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 476] |
| 7G6-<br>LCzu8 | With leader [SEQ ID NO:<br>477]:<br>ATGGGCTGGTCCTGCATCATCCTG<br><u>TTTCTGGTGGCCACCGCCACCGGC</u><br>GTGCACAGCGACGTCGTGATGACA<br>CAGTCCCCCCTGTCCCTGCCTGT<br>GACCCTGGGACAGCCTGCCTCCATC<br>TCCTGCAGATCCTCCCAGTCCATC | With leader [SEQ ID<br>NO: 479]:<br>MGWSCIILFLVATATGVHSDVV<br>MTQSPLSLPVTLGQPASISCRS<br>SQSIHSNGNTYLEWFQQRPGQ<br>SPRRLISKVSNRFSGVPDRFSG<br>SGSGTDFTLKISRVEAEDVGVY<br>YCFQGSHVPFTFGQGTKLEIKR<br>C | ATGGGCTG<br>GTCCTGCA<br>TCATCCTG<br>TTTCTGGT<br>GGCCACCG<br>CCACCGGC<br>GTGCACAG<br>C | GACGTCGTGATGACACAG<br>TCCCCCCTGTCCCTGCCT<br>GTGACCCTGGGACAGCCT<br>GCCTCCATCTCCTGCAGA<br>TCCTCCCAGTCCATCGTG<br>CACTCCAACGGCAACACC<br>TACCTGGAATGGTTCCAG<br>CAGCGGCCCTGGCCAGTCT | CGAACTGTGGCTGCACCA<br>TCTGTCTTCATCTTCCCG<br>CCATCTGATGAGCAGTTG<br>AAATCTGGAACTGCCTCT<br>GTTGTGTGCCTGCTGAAT<br>AACTTCTATCCAGAGGAG<br>GCCAAAGTACAGTGGAAG<br>GTGGATAACGCCCTCCAA |

TABLE 1-continued

| | | |
|---|---|---|
| GTCCACTCCAACGGCAACACCTAC<br>CTGGAATGGTTCCAGCAGCGGCCT<br>GGCCAGTCTCCCAGACGGCTGATC<br>TCCAAGGTGTCCAACCGGTTCTCC<br>GGCTGCCCGACAGATTCTCCGGC<br>TCTGGCTCGGCCACCGACTTCACC<br>CTGAAGATCTCCCGGTGAAGCC<br>GAGGACGTGGGCGTGTACTACTGT<br>TTTCAAGGCTCCCAGTGCCCTTC<br>ACCTTCGGCCAGGGCACCAAGCTG<br>GAAATCAAACGAACTGTGGCTGCA<br>CCATCTGTCTTCATCTTCCCGCCA<br>TCTGATGAGCAGTTGAAATCTGGA<br>ACTGCCTCTGTTGTGTGCCTGCTG<br>AATAACTTCTATCCCAGAGAGGCC<br>AAAGTACAGTGGAAGGTGGATAAC<br>GCCCTCCAATCGGGTAACTCCAG<br>GAGAGTGTCACAGAGCAGGACAGC<br>AAGGACAGCACCTACAGCCTCAGC<br>AGCACCCTGACGCTGAGCAAAGCA<br>GACTACGAGAAACAAAGTCTAC<br>GCCTGCGAAGTCACCCATCAGGGC<br>CTGAGCTCGCCCGTCACAAAGAGC<br>TTCAACAGGGAGAGTGTTGA<br>Without leader [SEQ ID<br>NO: 478]:<br>GACGTCGTGATGACACAGTCCCCC<br>CTGTCCCTGCCTGTGACCCTGGGA<br>CAGCCTGCCTCCATCTCCTGCAGA<br>TCCTCCCAGTCCATCGTGCACTCC<br>AACGGCAACACCTACCTGGAATGG<br>TTCCAGCAGCGGCCTGGCCCAGTCT<br>CCCAGACGGCTGATCTCCAAGGTG<br>TCCAACCGGTTCTCCGGCCTGCCC<br>GACAGATTCTCCGGCTCTGGCTCT<br>GGCACCGACTTCACCCTGAAGATC<br>TCCCGGGTGAAGCCGAGGACGTG<br>GGCGTGTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>GCACCGACTTCACCCTGAAGATC<br>CAGTTGAAATCTGGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCACCCTG<br>ACGCTGAGCAAAGCAGACTACGAG<br>AAACACAAAGTCTACGCCTGCGAA | TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 480]:<br>DVVMTQSPLSLPVTLGQPASIS<br>CRSSQSIVHSNGNTYLEWFQQR<br>PGQSPRRLISKVSNRFSGVPDR<br>FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | CCCAGACGGCTGATCTCC<br>AAGGTGTCCAACCGGTTC<br>TCCGGCTGCCCGACAGA<br>TTCTCCGGCTCTGGCTCT<br>GGCACCGACTTCACCCTG<br>AAGATCTCCCGGGTGGAA<br>GCCGAGGACGTGGGCGTG<br>TACTACTGTTTTCAAGGC<br>TCCCACGTGCCCTTCACC<br>TTCGGCCAGGGCACCAAG<br>CTGGAAATCAAA<br>(nucleotides 58 to<br>393 of SEQ ID NO:<br>477)<br>[SEQ ID NO: 482]<br>DVVMTQSPLSLPVTLGQP<br>ASISCRSSQSIVHSNGNT<br>YLEWFQQRPGQSPRRLIS<br>KVSNRFSGVPDRFSGSGS<br>GTDFTLKISRVEAEDVGV<br>YYCFQGSHVPFTFGQGTK<br>LEIK<br>[SEQ ID NO: 483] | TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGAGAGTGT<br>(nucleotides 394<br>to 714 of SEQ ID<br>NO: 477)<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 484] |

TABLE 1-continued

| | | | |
|---|---|---|---|
| | | GTCACCATCAGGGCCTGAGCTCG<br>CCCGTCACAAAGAGCTTCAACAG<br>GGAGAGTGTTGA | | |
| 7G6-<br>LCzu9 | With leader [SEQ ID NO:<br>485]:<br>ATGGGCTGTCCTGCATCATCCTG<br>TTTCTGTGGCCACCGCCACCGGC<br>GTGCACAGCGACGTCGTGATGACA<br>CAGTCCCCGCTGTCCCTGCCTGT<br>ACCTGGACAGCCTGCCTCCATC<br>TCCTGCAGATCTCCAGTCCATC<br>GTCACTCCAACGCAACACCTAC<br>CTGAACTGGTTCCAGCAGCGGCCT<br>GGCCAGTCTCCGAGACTGCTGATC<br>TCCAAGGTGTCCAACCGGTTCTCC<br>GGCGTGCCCGACAGATTCTCCGGC<br>TCTGGCTCTGGCACCGACTTCACC<br>CTGAAGATCTCCCGGGTCGAAGCC<br>GAGGACGTGGGCGTGTACTACTGT<br>TTTCAAGGCTCCCACGTGCCCTTC<br>ACCTTCGGCCAGGGCACCAAGCTG<br>GAAATCAAACGAACTGTGGCTGCA<br>CCATCGTCTTCATCTTCCCGCCA<br>TCTGATGAGCAGTTGAAATCTGGA<br>ACTGCCTCTGTTGTGTGCCTGCTG<br>AATAACTTCTATCCCAGAGAGGCC<br>AAAGTACAGTGGAAGGTGATAAC<br>GCCCTCCAATCGGGTAACTCCCAG<br>GAGAGTGTCACAGAGCAGGACAGC<br>AAGGACAGCACCTACTCCCTGAGC<br>AGCACCCTGACGCTGAGCAAAGCA<br>GACTACGAGAAACACAAAGTCTAC<br>GCCTGCGAAGTCACCCATCAGGGC<br>CTGAGCTCCCCGTCACAAAGAGC<br>TTCAACAGGGAGAGTGTTGA<br>[SEQ ID NO: 491]<br>Without leader [SEQ ID<br>NO: 486]:<br>GACGTCGTGATGACACAGTCCCC<br>CTGTCCCTGCCTGTGACCCTGGA<br>CAGCCTGCCTCCATCTCCTGCAGA<br>TCCTCCCAGTCCATCGTGCACTCC<br>AACGGCAACACCTACCTGAACTGG<br>TTCCAGCAGCGGCCTGGCCAGTCT<br>CCGGAGACTGCTGATCTCCAAGTG<br>TCCAACCGGTTCTCCGGCGTGCCC<br>GACAGATTCTCCGGCTCTGGCTCT<br>GGCACCGACTTCACCCTGAAGATC<br>TCCCGGGTGGAAGCCGAGGACGTG<br>GGCGTGTACTACTGTTTTCAAGGC<br>TCCCACGTGCCCTTCACCTTCGGC<br>CAGGGCACCAAGCTGGAAATCAAA | ATGGGCTG<br>GTCCTGCA<br>TCATCCTG<br>TTTCTGGT<br>GGCCACCG<br>CCACCGGC<br>GTGCACAG<br>C<br>(nucleotides<br>1<br>to 57 of<br>SEQ ID<br>NO: 485)<br>[SEQ ID<br>NO: 489] | With leader [SEQ ID<br>NO: 487]:<br>MGWSCIILFLVATATGVHSDVV<br>MTQSPLSLPVTLGQPASISCRS<br>SQSIVHSNGNTYLNWFQQRPGQ<br>SPRRLISKVSNRFSGVPDRFSG<br>SGSGTDFTLKISRVEAEDVGVY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 488]:<br>DVVMTQSPLSLPVTLGQPASIS<br>CRSSQSIVHSNGNTYLNWFQQR<br>PGQSPRRLISKVSNRFSGVPDR<br>FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | GACGTCGTGATGACACAG<br>TCCCCCCTGTCCCTGCCT<br>GTGACCCTGGGACAGCCT<br>GCCTCCATCTCCTGCAGA<br>TCCTCCCAGTCCATCGTG<br>CACTCCAACGGCAACACC<br>TACCTGAACTGGTTCCAG<br>CAGCGGCCTGGCCAGTCT<br>CCGGAGACGGCTGATCTCC<br>AAGGTGTCCAACCGGTTC<br>TCCGGCGTGCCCGACAGA<br>TTCTCCGGCTCTGGCTCT<br>GGCACCGACTTCACCCTG<br>AAGATCTCCCGGGTGGAA<br>GCCGAGGACGTGGGCGTG<br>TACTACTGTTTTCAAGGC<br>TCCCACGTGCCCTTCACC<br>TTCGGCCAGGGCACCAAG<br>CTGGAAATCAAA<br>(nucleotides 58 to<br>393 of SEQ ID NO:<br>485)<br>[SEQ ID NO: 490]<br>DVVMTQSPLSLPVTLGQP<br>ASISCRSSQSIVHSNGNT<br>YLNWFQQRPGQSPRRLIS<br>KVSNRFSGVPDRFSGSGS<br>GTDFTLKISRVEAEDVGV<br>YYCFQGSHVPFTFGQGTK<br>LEIK | CGAACTGTGGCTGCACCA<br>TCTGTCTTCATCTTCCCG<br>CCATCTGATGAGCAGTTG<br>AAATCTGGAACTGCCTCT<br>GTTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTGAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGAGAGTGT<br>(nucleotides 394<br>to 714 of SEQ ID<br>NO: 485)<br>[SEQ ID NO: 492]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 493] |

TABLE 1-continued

| | | | |
|---|---|---|---|
| | CGAACTGTGGCTGCACCATCTGTC TTCATCTTCCCGCCATCTGATGAG CAGTTGAAATCTGGCTGAACTGCCTCT GTTGTGTGCCTGCTGAATAACTTC TATCCCAGAGAGGCCAAAGTACAG TGGAAGGTGGATAACGCCCTCCAA TCGGTAACTCCAGGACAGTGTC ACAGAGCAGGACAGCAGCAGACAGC ACCTACAGCCTCAGCAGCACCCTG ACGCTGAGCAAAGCAGACTACGAG AAACACAAAGTCTACGCCTGCGAA GTCACCCATCAGGGCCTGAGCTCG CCCGTCACAAAGAGCTTCAACAGG GGAGAGTGTTGA | | |
| 7G6-LCzu10 | With leader [SEQ ID NO: 494]: ATGGGCTGGTCCTGCATCATCCTG TTTCTGGTGCCACACGCCACCGGC GTGCACAGCGACGTCGTGATGACA CAGTCCCCCCTGTCCCTGCCTGTG CAGTCCCCCCTGTCCCTGCCTGTG ACCCTGGGACAGCCTGCCTCCATC TCCTGCAGATCCTCCAGTCCATC GTGCACTCCAACGGCAACACCTAC CTGGAATGGTTCCAGCAGCGGCCT GGCAGTCCCAGACGGCTGATC TACAAGGTGTCCAACCGGTTCTCC GGCGTCCCCGACAGATTCTCCGGC TCTGGCTCTGGCACCGACTTCACC CTGAAGATCTCCCGGGTGGAAGCC GAGGACGTGGGCGTGTATACTGT TTTCAAGGCTCCCACGTGCCCTTC ACCTTCGGCCAGGGCACCAAGCTG GAAATCAAACGAACTGTGGCTGCA CCATCTGTCTTCATCTTCCCGCCA TCTGATGAGCAGTTGAAATCTGGA ACTGCCTCTGTTGTGTGCCTGCTG AATAACTTCTATCCCAGAGAGGCC AAAGTACAGTGGAAGGTGGATAAC GCCCTCCAATCGGGTAACTCCCAG GAGAGTGTCACAGAGCAGGACAGC AAGGACAGCACCTACAGCCTCAGC AGCACCCTGACGCTGAGCAAAGCA GACTACGAGAAACACAAAGTCTAC GCCTGCGAAGTCACCCATCAGGGC CTGAGCTCGCCCGTCACAAAGAGC TTCAACAGGGGAGAGTGTTGA Without leader [SEQ ID NO: 495]: GACGTCGTGATGACACAGTCCCCC CTGTCCCTGCCTGTGACCCTGGGA CAGCCTGCCTCCATCTCCTGCAGA TCCTCCCAGTCCATCGTGCACTCC | With leader [SEQ ID NO: 496]: ATGGGCTG GTCCTGCA TCATCCTG TTTCTGGT GGCCACCG CCACCGGC GTGCACAG C (nucleotides 1 to 57 of SEQ ID NO: 494) Without leader [SEQ ID NO: 497]: DVVMTQSPLSLPVTLGQPASIS CRSQSIVHSNGNTYLEWFQQR PGQSPRRLIYKVSNRFSGVPDR FSGSGSGTDFTLKISRVEAEDV GVYYCFQGSHVPFTFGQGTKLE IKRTVAAPSVFIFPPSDEQLKS GTASVVCLLNNFYPREAKVQWK VDNALQSGNSQESVTEQDSKDS TYSLSSTLTLSKADYEKHKVYA CEVTHQGLSSPVTKSFNRGEC | GACGTCGTGATGACACAG TCCCCCCTGTCCCTGCCT GTGACCCTGGGACAGCCT GCCTCCATCTCCTGCAGA TCCTCCCAGTCCATCGTG CACTCCAACGGCAACACC TACCTGGAATGGTTCCAG CAGCGGCCTGGCCAGTCT CCCAGACGGCTGATCTAC AAGGTGTCCAACCGGTTC TCCGGCGTGCCCGACAGA TTCTCCGGCTCTGGCTCT GGCACCGACTTCACCCTG AAGATCTCCCGGGTGGAA GCCGAGGACGTGGGCGTG TACTACTGTTTTCAAGGC TCCCACGTGCCCTTCACC TTCGGCCAGGGCACCAAG CTGGAAATCAAA (nucleotides 58 to 393 of SEQ ID NO: 494) [SEQ ID NO: 499] DVVMTQSPLSLPVTLGQP ASISCRSSQSIVHSNGNT YLEWFQQRPGQSPRRLIY KVSNRFSGVPDRFSGSGS GTDFTLKISRVEAEDVGV YYCFQGSHVPFTFGQGTK LEIK [SEQ ID NO: 500] | CGAACTGTGGCTGCACCA TCTGTCTTCATCTTCCCG CCATCTGATGAGCAGTTG AAATCTGGAACTGCCTCT GTTGTGTGCCTGCTGAAT AACTTCTATCCCAGAGAG GCCAAAGTACAGTGGAAG GTGATAACGCCCTCCAA TCGGGTAACTCCCAGGAG AGTGTCACAGAGCAGGAC AGCAAGGACAGCACCTAC AGCCTCAGCAGCACCCTG ACGCTGAGCAAAGCAGAC TACGAGAAACACAAAGTC TACGCCTGCGAAGTCACC CATCAGGGCCTGAGCTCG CCCGTCACAAAGAGCTTC AACAGGGGAGAGTGT (nucleotides 394 to 714 of SEQ ID NO: 494) [SEQ ID NO: 501] RTVAAPSVFIFPPSDEQL KSGTASVVCLLNNFYPRE AKVQWKVDNALQSGNSQE SVTEQDSKDSTYSLSSTL TLSKADYEKHKVYACEVT HQGLSSPVTKSFNRGEC [SEQ ID NO: 502] |

TABLE 1-continued

|  | | | |
|---|---|---|---|
| | AACGGCAACACCTACCTGGAATGG<br>TTCCAGCAGCCTGGCCTGGCCAGTCT<br>CCCAGACGCTGATCTACAAGGTG<br>TCCAACCGGTTCTCCGGCGTGCCC<br>GACAGATTCTCCGGCTCTGGCTCT<br>GGCACCGACTTCACCCTGAAGATC<br>TCCCGGGTGGAAGCCGAGGACGTG<br>GGCGTGTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCAGGAGAGTGTC<br>ACAGAGCAGGACAGCAAGGACAGC<br>ACCTACAGCCTCAGCAGCACCCTG<br>ACGCTGAGCAAAGCAGACTACGAG<br>AAACACAAAGTCTACGCCTGCGAA<br>GTCACCCATCAGGGCCTGAGCTCG<br>CCCGTCACAAAGAGCTTCAACAGG<br>GGAGAGTGTTGA | | | |
| 7G6-<br>LCzu1 | With leader [SEQ ID NO:<br>503]:<br>ATGGGCTGGTCCTGCATCATCCTG<br>TTTCTGGTGGCCACCGCCACCGGC<br>GTGCACAGCGATATCCAGATGACC<br>CAGTCCCCTTCCAGTCCTGTCCGC<br>TCTGTGGGCGACAGAGTGACCATC<br>ACCTGTCGTTCCAGCCAGTCCATC<br>CTGCACTCCAACGGCAACACCTAC<br>CTGGAATGGTATCAGCAGAAGCCC<br>GGCAAAGCCCCTAAGCTGCTGATC<br>TACAAGGTGTCCAACCGGTTCTCC<br>GGCGTGCCCTCCAGATTCTCCGGC<br>TCTGGCTCTGGCACCGACTTCACC<br>CTGACCATCTCCAGCCTCCAGCCC<br>GAGGACTTCGCCACCTACTACTGT<br>TTTCAAGGCTCCCACGTGCCCTTC<br>ACCTTCGGCCAGGGCACCAAGCTG<br>GAAATCAAAGAACTGTGGCTGCA<br>CCATCTGTCTTCATCTTCCCGCCA<br>TCTGATGAGCAGTTGAAATCTGGA<br>ACTGCCTCTGTTGTGTGCCTGCTG<br>AATAACTTCTATCCCAGAGAGGCC<br>AAAGTACAGTGGAAGGTGGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACGCTGAGCAAAGCA | With leader [SEQ ID<br>NO: 505]:<br>MGWSCIILFLVATATGVHSDIQ<br>MTQSPSSLSASVGDRVTITCRS<br>SQSILHSNGNTYLEWYQQKPGK<br>APKLLIYKVSNRFSGVPSRFSG<br>SGSGTDFTLTISSLQPEDFATY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 506]:<br>DIQMTQSPSSLSASVGDRVTIT<br>CRSSQSILHSNGNTYLEWYQQK<br>PGKAPKLLIYKVSNRFSGVPSR<br>FSGSGSGTDFTLTISSLQPEDF<br>ATYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | ATGGGCTG<br>GTCCTGCA<br>TCATCCTG<br>TTTCTGGT<br>GGCCACCG<br>CCACCGGC<br>GTGCACAG<br>C<br>(nucleotides<br>1<br>to 57 of<br>SEQ ID<br>NO: 503)<br>[SEQ ID<br>NO: 507] | GATATCCAGATGACCCAG<br>TCCCCTTCCAGCCTGTCC<br>GCCTCTGTGGGCGACAGA<br>GTGACCATCACCTGTCGG<br>TCCTCCCAGTCCATCCTG<br>CACTCCAACGGCAACACC<br>TACCTGGAATGGTATCAG<br>CAGAAGCCCGGCAAGGCC<br>CCTAAGCTGCTGATCTAC<br>AAGGTGTCCAACCGGTTC<br>TCCGGCGTGCCCTCCAGA<br>TTCTCCGGCTCTGGCTCT<br>GGCACCGACTTCACCCTG<br>ACCATCTCCAGCCTCCAG<br>CCCGAGGACTTCGCCACC<br>TACTACTGTTTTCAAGGC<br>TCCCACGTGCCCTTCACC<br>TTCGGCCAGGGCACCAAG<br>CTGGAAATCAAACGAACT<br>GTGGCTGCACCATCTGTC<br>TTCATCTTCCCGCCATCT<br>GATGAGCAGTTGAAATCT<br>GGAACTGCCTCTGTTGTG<br>TGCCTGCTGAATAACTTC<br>TATCCCAGAGAGGCCAAA<br>GTACAGTGGAAGGTGGAT<br>AACGCCCTCCAATCGGGT<br>AACTCCCAGGAGAGTGTC<br>DIQMTQSPSSLSASVGDR<br>VTITCRSSQSILHSNGNT<br>YLEWYQQKPGKAPKLLIY<br>KVSNRFSGVPSRFSGSGS<br>GTDFTLTISSLQPEDFAT |
| | | | (nucleotides 58 to<br>393 of SEQ ID NO:<br>503)<br>[SEQ ID NO: 508] | |

TABLE 1-continued

| | | | |
|---|---|---|---|
| | GACTACGAGAAACACAAGTCTAC<br>GCCTGGGAAGTCACCCATCAGGGC<br>CTGAGCTCGCCCGTCACAAAGAC<br>TTCAACAGGGAGAGTGTTGA<br>Without leader [SEQ ID<br>NO: 504]:<br>GATATCCAGATGACCCAGTCCCCT<br>TCCAGCCTGTCCGCCTCTGTGGGC<br>GACAGAGTGACCATCACCTGTCG<br>TCCTCCAGTCCATCCTGCACTCC<br>AACGGCAACACCTACCTGAATG<br>TATCAGCAGAAGCCCGGCAAGGCC<br>CCTAAGCTGCTGATCTACAAGGTG<br>CCAACCGGTTCTCCGGCGTGCCC<br>TCCAGATTCTCCGGCTCTGGCTCT<br>GGCACCGACTTCACCCTGACCATC<br>TCCAGCCTCCAGCCCGAGGACTTC<br>GCCACTCATCTGTTTCAAGGC<br>TCCCACGGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGACAGC<br>ACCTACAGCCTCAGCAGCAGACAGAG<br>ACGTGAGCAAAGCTACGCCTGCGAA<br>GTCACCCATCAGGGCCTGAGCTCG<br>CCCGTCACAAAGAGCTTCAACAGG<br>GGAGAGTGTTGA | | YYCFQGSHVPFTFGQGTK<br>LEIK<br>[SEQ ID NO: 509] | ACAGAGCAGGACAGCAAG<br>GACAGCACCTACAGCCTC<br>AGCAGCACCCTGACGCTG<br>AGCAAAGCAGACTACGAG<br>AAACACAAAGTCACCAGCC<br>TGCGAAGTCACCCATCAG<br>GGCCTGAGCTCGCCCGTC<br>ACAAAGAGCTTCAACAGG<br>GGAGAGTGT<br>(nucleotides 394<br>to 714 of SEQ ID<br>NO: 503)<br>[SEQ ID NO: 510]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 511] |
| 7G6-<br>LCzu12 | With leader [SEQ ID NO: 512]:<br>ATGGGCTGGTCCTGCATCATCCTG<br>TTTCTGGTGGCCACCGCCACCGGC<br>GTGCACAGCGACGTGCAGATGACC<br>CAGTCCCCTTCCAGCCTGTCTGCC<br>TCCGTGGGCGACAGAGTGACCATC<br>ACCTGTCGGTCCTCCCAGTCCATC<br>CTGCACTCCAACGGCAACACCTAC<br>CTGGAATGGTATCAGCAGAAGCCC<br>GGCAAGGCCCCTAAGCTGCTGATC<br>TGCAAGGTGTCCAACCGGTTCTCC<br>GGCGTCTGGCTCCAGATTCTCC<br>GGCTCTGGCACCGACTTCACC<br>CTGACCATCTCCAGCCTCCAGCCC<br>GAGGACTTCGCCACTACTGT<br>TTTCAAGGCTCCCACGGCCCTTC<br>ACCTTCGGCCAGGGCACCAAGCTG | ATGGGGCTG<br>GTCCTGCA<br>TCATCCTG<br>TTTCTGGT<br>GGCCACCG<br>CCACCGGC<br>GTGCACAG<br>C<br>(nucleotides<br>1<br>to 57 of<br>SEQ ID<br>NO: 512) | With leader [SEQ ID NO: 514]:<br>MGWSCIILFLVATATGVHSDVQ<br>MTQSPSSLSASVGDRVTITCRS<br>SQSILHSNGNTYLEWYQQKPGK<br>APKLLICKVSNRFSGVPSRFSG<br>SGSGTDFTLTISSLQPEDFATY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID NO: 515]:<br>DVQMTQSPSSLSASVGDRVTIT<br>CRSSQSILHSNGNTYLEWYQQK<br>PGKAPKLLICKVSNRFSGVPSR | GACGTGCAGATGACCCAG<br>TCCCCTTCCAGCCTGTCT<br>GCCTCCGTGGGCGACAGA<br>GTGACCATCACCTGTCGG<br>TCCTCCCAGTCCATCCTG<br>CACTCCAACGGCAACACC<br>TACCTGGAATGGTATCAG<br>CAGAAGCCCGGCAAGGCC<br>CCTAAGCTGCTGATCTGC<br>AAGGTGTCCAACCGGTTC<br>TCCGGCGTGCCCTCTCGG<br>TTCTCCGGCTCTGGCTCT<br>GGCACCGACTTCACCCTG<br>ACCATCTCCAGCCTCCAG<br>CCCGAGGACTTCGCCACC<br>TACTACTGTTTTCAAGGC<br>TCCCACGGCCCTTCACC<br>TTCGGCCAGGGCACCAAG | CGAACTGTGGCTGCACCA<br>TCTGTCTTCATCTTCCCG<br>CCATCTGATGAGCAGTTG<br>AAATCTGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACCCTGCGAAGTCACC<br>CATCAGGGCCTGAGCTCG<br>CCCGTCACAAAGAGCTTC<br>AACAGGGGAGAGTGT |

TABLE 1-continued

| | | | | |
|---|---|---|---|---|
| | GAAATCAAACGAACTGTGGCTGCA CCATCTGTCTTCATCTTCCCGCCA TCTGATGAGCAGTTGAAATCTGGA ACTGCCTCTGTTGTGTGCCTGCTG AATAACTTCTATCCCAGAGAGGCC AAAGTACAGTGGAAGGTGGATAAC GCCCTCCAATCGGGTAACTCCAG GAGAGTGTCACAGAGCAGGACAGC AAGGACACAGCACCTACAGCCTCAGC AGCACCCTGACCCTGAGCAAAGCA GACTACGAGAAACAAAGTCTAC GCCTGCGAAGTCACCCATCAGGGC CTGAGCTCGCCCGTCACAAAGAGC TTCAACAGGGGAGAGTGTTGA Without leader [SEQ ID NO: 513]: GACGTGCAGATGACCCAGTCCCCT TCCAGCCTGTCTGCCTCCGTGGGC GACAGAGTGACCATCACCTGTCGG TCCTCCCAGTCCATCCTGCACTCC AACGGCAACACCTACCTGGAATGG TATCAGCAGAAGCCCGGCAAGGCC CCTAAGCTGCTGATCTGCAAGGTG TCCAACCGGTTCTCCGGCGTGCCC TCCAGATTCTCCGGCTCTGGCTCT GGCACCGACTTCACCCTGACCATC TCCAGCCTCCAGCCCGAGGACTTC GCCACTACTACTGTTTTCAAGGC TCCCAGTGCCCTTCACCTTCGGC CAGGGCACCAAGCTGGAAATCAAA CGAACTGTGGCTGCACCATCTGTC TTCATCTTCCCGCCATCTGATGAG CAGTTGAAATCTGGTACTGCCTCT GTTGTGTGCCTGCTGAATAACTTC TATCCCAGAGAGGCCAAAGTACAG TGGAAGGTGGATAACGCCCTCCAA TCGGGTAACTCCCAGGAGAGTGTC ACAGAGCAGGACAGCAAGGACAGC ACCTACAGCCTCAGCAGCACCCTG ACGCTGAGCAAAGCAGACTACGAG AAACACAAAGTCTACGCCTGCGAA GTCACCCATCAGGGCCTGAGCTCG CCCGTCACAAAGAGCTTCAACAGG GGAGAGTGTTGA | FSGSGSGTDFTLTISSLQPEDF ATYYCFQGSHVPFTFGQGTKLE IKRTVAAPSVFIFPPSDEQLKS GTASVVCLLNNFYPREAKVQWK VDNALQSGNSQESVTEQDSKDS TYSLSSTLTLSKADYEKHKVYA CEVTHQGLSSPVTKSFNRGEC | CTGAAATCAAA (nucleotides 58 to 393 of SEQ ID NO: 512) [SEQ ID NO: 517] DVQMTQSPSSLSASVGDR VTITCRSSQSILHSNGNT YLEWYQQKPGKAPKLLIC KVSNRFSGVPSRFSGSGS GTDFTLTISSLQPEDFAT YYCFQGSHVPFTFGQGTK LEIK [SEQ ID NO: 518] | (nucleotides 394 to 714 of SEQ ID NO: 512) [SEQ ID NO: 519] RTVAAPSVFIFPPSDEQL KSGTASVVCLLNNFYPRE AKVQWKVDNALQSGNSQE SVTEQDSKDSTYSLSSTL TLSKADYEKHKVYACEVT HQGLSSPVTKSFNRGEC [SEQ ID NO: 520] |
| 7G6-LCzu13 | With leader [SEQ ID NO: 521]: ATGGGCTGGTCCTGCATCATCCTG TTTCTGGTGGCCACCGCCACCGGC GTGCACAGCGACGTGCAGATGACC CAGTCCCCTTCCAGCCTGTCTGCC TCCGTGGGCGACAGAGTGACCATC ACCTGTCGGTCCTCCCAGTCCATC | With leader [SEQ ID NO: 523]: MGWSCIILFLVATATGVHSDVQ MTQSPSSLSASVGDRVTITCRS SQSILHSNGNTYLEWYQQKPGK APKLLIYKVSNRFSGVPSRFSG SGSGTDFTLTISSLQPEDFATY YCFQGSHVPFTFGQGTKLEIKR C | ATGGGCTG GTCCTGCA TCATCCTG TTTCTGT GGCCACCG CCACCGGC GTGCACAG | GACTGCAGATGACCCAG TCCCCTTCCAGCCTGTCT GCCTCCGTGGGCGACAGA GTGACCATCACCTGTCGG TCCTCCCAGTCCATCCTG CACTCCAACGGCAACACC TACCTGGAATGGTATCAG CAGAAGCCCGGCAAGGCC | CGAACTGTGGCTGCACCA TCTGTCTTCATCTTCCCG CCATCTGATGAGCAGTTG AAATCTGGAACTGCCTCT GTTGTGTGCCTGCTGAAT AACTTCTATCCCAGAGAG GCCAAAGTACAGTGGAAG GTGGATAACGCCCTCCAA |

TABLE 1-continued

| | | |
|---|---|---|
| CTGCACTCCAACGGCAACACCTAC<br>CTGGAATGGTATCAGCAGAAGCCC<br>GGCAAGGCCCCTAAGCTGCTGATC<br>TACAAGGTGTCCAACCGGTTCTCC<br>GGCTGCCCCTCCAGATTCTCCGGC<br>TCTGGCTCTGGCACCGACTTCACC<br>CTGACCATTCCAGCCTCCAGCCCC<br>GAGGACTTCGCCACCTACTACTGT<br>TTTCAAGGCTCCCACGTGCCCTTC<br>ACCTTCGGCCAGGGCACCAAGCTG<br>GAAATCAAACGAACTGTGGCTGCA<br>CCATCTGTCTTCATCTTCCCGCCA<br>TCTGATGAGCAGTTGAAATCTGGA<br>ACTGCCTCTGTTGTGTGCCTGCTG<br>AATAACTTCTATCCCAGAGAGGCC<br>AAAGTACAGTGGAAGGTGGATAAC<br>GCCCTCAATGGGTAACTCCCAG<br>GAGAGTGTCACAGAGCAGGACAGC<br>AAGGACAGCACCTACAGCCTCAGC<br>AGCACCCTGACGCTGAGCAAAGCA<br>GACTACGAGAAACAAAGTCTAC<br>GCCTGCGAAGTCACCCATCAGGGC<br>CTGAGCTCGCCCGTCACAAAGAGC<br>TTCAACAGGGGAGAGTGTTGA<br>Without leader [SEQ ID<br>NO: 522]:<br>GACGTGCAGATGACCCAGTCCCCT<br>TCCAGCCTGTCTGCCTCCGTGGGC<br>GACAGAGTGACCATCACCTGTCGG<br>TCCTCCCAGTCCATCCTGCACTCC<br>AACGGCAACACCTACCTGGAATGG<br>TATCAGCAGAAGCCCGGCAAGGCC<br>CCTAAGCTGCTGATCTACAAGGTG<br>TCCAACCGGTTCTCCGGCCTGCCC<br>TCCAGATTCTCCGGCTCTGGCTCT<br>GGCACCGACTTCACCCTGACCATC<br>TCCAGCCTCCAGCCCGAGGACTTC<br>GCCACCTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCACCCTG<br>ACGCTGAGCAAAGCAGACTACGAG<br>AAACACAAAGTCTACGCCTGCGAA | TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 524]:<br>DVQMTQSPSSLSASVGDRVTIT<br>CRSSQSILHSNGNTYLEWYQQK<br>PGKAPKLLIYKVSNRFSGVPSR<br>FSGSGSGTDFTLTISSLQPEDF<br>ATYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC<br>(nucleotides<br>1 to 57 of SEQ ID<br>NO: 521)<br>[SEQ ID<br>NO: 525] | CCTAAGCTGCTGATCTAC<br>AAGGTGTCCAACCGGTTC<br>TCCGGCGTGCCCTCCAGA<br>TTCTCCGGCTCTGGCTCT<br>GGCACCGACTTCACCCTG<br>ACCATTCCAGCCTCCAG<br>CCCGAGGACTTCGCCACC<br>TACTACTGTTTTCAAGGC<br>TCCCACGTGCCCTTCACC<br>TTCGGCCAGGGCACCAAG<br>CTGGAAATCAAA<br>(nucleotides 58 to<br>393 of SEQ ID NO:<br>521)<br>[SEQ ID NO: 526]<br>DVQMTQSPSSLSASVGDR<br>VTITCRSSQSILHSNGNT<br>YLEWYQQKPGKAPKLLIY<br>KVSNRFSGVPSRFSGSGS<br>GTDFTLTISSLQPEDFAT<br>YYCFQGSHVPFTFGQGTK<br>LEIK<br>[SEQ ID NO: 527] | TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGT<br>(nucleotides 394<br>to 714 of SEQ ID<br>NO: 521)<br>[SEQ ID NO: 528]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 529] |

TABLE 1-continued

| | | | |
|---|---|---|---|
| | | GTCACCACCATCAGGGCCTGAGCTCG<br>CCCGTCACAAGAGCTTCAACAGG<br>GGAGAGTGTTGA | | |
| 7G6-<br>LCzu14 | With leader [SEQ ID NO:<br>530]:<br>ATGGGCTGTCCTGCATCATCCTG<br>TTTCTGTGTGGCCACCGCCACCGGC<br>GTGCACAGCGATATCCAGATGACC<br>CAGTCCCCTTCCAGCCTGTCCGCC<br>TCTGTGGGCGACAGAGTGACCATC<br>ACCTGTCGTCCTCCCAGTCCATC<br>CTGCACTCCAACGGCAACACCTAC<br>CTGGAATGGTATCAGCAGAAGCCC<br>GGCAAGGCCCTAAGCTGCTGATC<br>TGCAAGGTGTCCAACCGGTTCTCC<br>GGCGTGCCCTCCAGATTCTCCGGC<br>TCTGGCTCTGGCACCGACTTCACC<br>CTGACCATCTCCAGCCTCCAGCCC<br>GAGGACTTCGCCACCTACTACTGT<br>TTTCAAGGCTCCCAGTGCCCTTC<br>ACCTTCGGCCAGGGCACCAAGCTG<br>GAAATCAAGCGTACGGTGGCTGCA<br>CCATCGTCTTCATCTTCCCGCCA<br>TCTGATGAGCAGTTGAAATCTGGA<br>ACTGCCTCTGTTGTGTGCCTGCTG<br>AATAACTTCTATCCCAGAGAGGCC<br>AAAGTACAGTGGAAGGTGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACGCTGAGCAAAGCA<br>GACTACGAGAAACAAAGTCTAC<br>GCCTGCGAAGTCACCCATCAGGGC<br>CTGAGCTCCCCGTCACAAAGAGC<br>TTCAACAGGGAGAGTGTTGA<br>Without leader [SEQ ID<br>NO: 531]:<br>GATATCCAGATGACCCAGTCCCCT<br>TCCAGCCTGTCCGCCTCTGTGGGC<br>GACAGAGTGACCATCACCTGTCGG<br>TCCTCCAGTCCATCCTGCACTCC<br>AACGGCAACACCTACCTGGAATGG<br>TATCAGCAGAAGCCCGGCAAGGCC<br>CCTAAGCTGCTGATCTGCAAGGTG<br>TCCAACCGGTTCTCCGGCGTGCCC<br>TCCAGATTCTCCGGCTCTGGCTCT<br>GGCACCGACTTCACCCTGACCATC<br>TCCAGCCTCCAGCCCGAGGACTTC<br>GCCACCTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC | With leader [SEQ ID NO:<br>532]:<br>MGWSCIILFLVATATGVHSDIQ<br>MTQSPSSLSASVGDRVTITCRS<br>SQSILHSNGNTYLEWYQQKPGK<br>APKLLICKVSNRFSGVPSRFSG<br>SGSGTDFTLTISSLQPEDFATY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 533]:<br>DIQMTQSPSSLSASVGDRVTIT<br>CRSSQSILHSNGNTYLEWYQQK<br>PGKAPKLLICKVSNRFSGVPSR<br>FSGSGSGTDFTLTISSLQPEDF<br>ATYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | GATATCCAGATGACCCAG<br>TCCCCTTCCAGCCTGTCC<br>GCCTCTGTGGGCGACAGA<br>GTGACCATCACCTGTCGG<br>TCCTCCAGTCCATCCTG<br>CACTCCAACGGCAACACC<br>TACCTGGAATGGTATCAG<br>CAGAAGCCCGGCAAGGCC<br>CCTAAGCTGCTGATCTGC<br>AAGGTGTCCAACCGGTTC<br>TCCGGCGTGCCCTCCAGA<br>TTCTCCGGCTCTGGCTCT<br>GGCACCGACTTCACCCTG<br>ACCATCTCCAGCCTCCAG<br>CCCGAGGACTTCGCCACC<br>TACTACTGTTTTCAAGGC<br>TCCCACGTGCCCTTCACC<br>TTCGGCCAGGGCACCAAG<br>CTGGAAATCAAA<br>(nucleotides 58 to<br>393 of SEQ ID NO:<br>530)<br>[SEQ ID NO: 535]<br>DIQMTQSPSSLSASVGDR<br>VTITCRSSQSILHSNGNT<br>YLEWYQQKPGKAPKLLIC<br>KVSNRFSGVPSRFSGSGS<br>GTDFTLTISSLQPEDFAT<br>YYCFQGSHVPFTFGQGTK<br>LEIK<br>[SEQ ID NO: 536] | CGAACTGTGGCTGCACCA<br>TCTGTCTTCATCTTCCCG<br>CCATCTGATGAGCAGTTG<br>AAATCTGGAACTGCCTCT<br>GTTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGAGAGTGTTGA<br>(nucleotides 394<br>to 714 of SEQ ID<br>NO: 530)<br>[SEQ ID NO: 537]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 538] |

TABLE 1-continued

| | | | | |
|---|---|---|---|---|
| | | TTCATCTTCCCGCCATCTGATGAG<br>CAGTTGAAATCTGGAACTGCCTCT<br>GTTGTGTGCTGCTGAATAACTTC<br>TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCAGCCTG<br>ACGCTGAGCAAAGCAGACTACGAG<br>AAACACAAAGTCTACGCCTGCGAA<br>GTCACCCATCACGGGCCTGAGCTCG<br>CCCGTCACAAAGAGCTTCAACAGG<br>GGAGAGTGTTGA | | |
| 7G6-<br>LCzu15 | With leader [SEQ ID NO:<br>539]:<br>ATGGGCTGGTCCTGCATCATCCTG<br>TTTCTGGTGGCCACCGCCACCGGC<br>GTGCACAGCGACGTGCAGATGACC<br>CAGTCCCCTTCCAGCCTGTCTGCC<br>TCCGTGGGCGACAGAGTGACCATC<br>ACCTGTCGGTCCTCCCAGTCCATC<br>CTGCACTCCAACGGCAACACCTAC<br>CTGGAATGGTATCAGCAGAAGCCC<br>GGCAAGGCCCCTAAGCTGCTGATC<br>TCCAAGGTGTCCAACCGGTTCTCC<br>GGCGTGCCCAGATTCTCCGGC<br>TCTGGCTCTGGCACCGACTTCACC<br>CTGACCATCTCCAGCCTCCAGCCC<br>GAGGACTTCGCCACCTACTACTGT<br>TTTCAAGGTCACAGTGCCCCTTC<br>ACCTTCGGCCAGGGCACCAAGGTG<br>GAAATCAAACGAACTGTGGCTGCA<br>CCATCTGTCTTCATCTTCCCGCCA<br>TCTGATGAGCAGTTGAAATCTGGA<br>ACTGCCTCTGTTGTGTGCCTGCTGA<br>ATAACTTCTATCCCAGAGAGGCC<br>AAAGTACAGTGGAAGGTGGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACGCTGAGCAAAGCA<br>GACTACGAGAAACACAAAGTCTAC<br>GCCTGCGAAGTCACCCATCAGGGC<br>CTGAGCTCCCCGTCACAAAGAGC<br>TTCAACAGGGGAGAGTGTTGA<br>Without leader [SEQ ID<br>NO: 540]:<br>GACGTGCAGATGACCCAGTCCCCT<br>TCCAGCCTGTCTGCCTCCGTGGGC<br>GACAGAGTGACCATCACCTGTCGG<br>TCCTCCCAGTCCATCCTGCACTCC<br>AACGGCAACACCTACCTGGAATGG | With leader [SEQ ID O:<br>541]:<br>MGWSCIILFLVATATGVHSDVQ<br>MTQSPSSLSASVGDRVTITCRS<br>SQSILHSNGNTYLEWYQQKPGK<br>APKLLISKVSNRFSGVPSRFSG<br>SGSGTDFTLTISSLQPEDFATY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID<br>NO: 542]:<br>DVQMTQSPSSLSASVGDRVTIT<br>CRSSQSILHSNGNTYLEWYQQK<br>PGKAPKLLISKVSNRFSGVPSR<br>FSGSGSGTDFTLTISSLQPEDF<br>ATYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | ATGGGCTG<br>GTCCTGCA<br>TCATCCTG<br>TTTCTGGT<br>GGCCACCG<br>CCACCGGC<br>GTGCACAG<br>C (nucleotides<br>1<br>to 57 of<br>SEQ ID<br>NO: 539)<br>[SEQ ID<br>NO: 543] | GACGTGCAGATGACCCAG<br>TCCCCTTCCAGCCTGTCT<br>GCCTCCGTGGGCGACAGA<br>GTGACCATCACCTGTCGG<br>TCCTCCAGTCCATCCTG<br>CACTCCAACGGCAACACC<br>TACCTGGAATGGTATCAG<br>CAGAAGCCCGGCAAGGCC<br>CCTAAGCTGCTGATCTCC<br>AAGGTGTCCAACCGGTTC<br>TCCGGCGTGCCCTCCAGA<br>TTCTCCGGCTCTGGCTCT<br>GGCACCGACTTCACCCTG<br>ACCATCTCCAGCCTCCAG<br>CCCGAGGACTTCGCCACC<br>TACTACTGTTTTCAAGGC<br>TCCCACGTGCCCTTCACC<br>TTCGGCCAGGGCACCAAG<br>CTGGAAATCAAA<br>(nucleotides 58 to<br>393 of SEQ ID NO:<br>539)<br>[SEQ ID NO: 544]<br>DVQMTQSPSSLSASVGDR<br>VTITCRSSQSILHSNGNT<br>YLEWYQQKPGKAPKLLIS<br>KVSNRFSGVPSRFSGSGS<br>GTDFTLTISSLQPEDFAT<br>YYCFQGSHVPFTFGQGTK<br>LEIK<br>[SEQ ID NO: 545] | CGAACTGTGGCTGCACCA<br>TCTGTCTTCATCTTCCCG<br>CCATCTGATGAGCAGTTG<br>AAATCTGGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGT<br>(nucleotides 394<br>to 714 of SEQ ID<br>NO: 539)<br>[SEQ ID NO: 546]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 547] |

TABLE 1-continued

7G6-LCzu16

With leader [SEQ ID NO: 548]:

ATGGGCTGGTCCTGCTGCATCATCCTG
TTTCTGGTGGCCACCGCCACGGC
GTGCACAGCAGCGACGTGCAGATGACC
CAGTCCCCTTCCAGCCTGTCTGCC
TCCGTGGGCACAGAGTGATCATC
ACCTGTCGTCCTCCCAGTCATC
GTGCACTCCAACGGCAACACCTAC
CTGGAATGGTATCAGCAGAAGCCC
GGCAAGGCCCCTAAGCTGCTGATC
TCCAAGGTGTCCAACCGGTTCTCC
GGCGTGCCCTCCAGATTCTCCGGC
TCTGGCTCTGGCACCGACTTCACC
CTGACCATCTCCAGCCTCCAGCCC
GAGGACTTCGCCACCTACTACTGT
TTTCAAGGCTCCCACGTGCCCTTC
ACCTTCGGCCAGGGCACCAAGCTG
GAAATCAAACGTACTGTGGCTGCA
CCATCTGTCTTCATCTTCCCGCCA
TCTGATGAGCAGTTGAAATCTGGA
ACTGCCTCTGTTGTGTGCCTGCTG
AATAACTTCTATCCCAGAGAGGCC
AAAGTACAGTGGAAGGTGGATAAC
GCCCTCCAATCGGGTAACTCCCAG
GAGAGTGTCACAGAGCAGGACAGC
AAGGACAGCACCTACAGCCTCAGC
AGCACGCTGACGCTGAGCAAAGCA
GACTACGAGAAACACAAAGTCTAC
GCCTGCGAAGTCACCCATCAGGGC
CTGAGCTCGCCCGTCACAAAGAGC
TTCAACAGGGGAGAGTGTTGA

With leader [SEQ ID NO: 550]:

MGWSCIILFLVATATGVHSDVQ
MTQSPSSLSASVGDRVTITCRS
SQSIVHSNGNTYLEWYQQKPGK
APKLLISKVSNRFSGVPSRFSG
SGSGTDFTLTISSLQPEDFATY
YCFQGSHVPFTFGQGTKLEIKR
TVAAPSVFIFPPSDEQLKSGTA
SVVCLLNNFYPREAKVQWKVDN
ALQSGNSQESVTEQDSKDSTYS
LSSTLTLSKADYEKHKVYACEV
THQGLSSPVTKSFNRGEC

Without leader [SEQ ID NO: 551]:

DVQMTQSPSSLSASVGDRVTIT
CRSSQSIVHSNGNTYLEWYQQK
PGKAPKLLISKVSNRFSGVPSR
FSGSGSGTDFTLTISSLQPEDF
ATYYCFQGSHVPFTFGQGTKLE
IKRTVAAPSVFIFPPSDEQLKS
GTASVVCLLNNFYPREAKVQWK
VDNALQSGNSQESVTEQDSKDS
TYSLSSTLTLSKADYEKHKVYA
CEVTHQGLSSPVTKSFNRGEC

GACTGTGCAGATGACCCAG
TCCCCTTCCAGCCTGTCT
GCCTCCGTGGGCGACAGA
GTGACCATCACCTGTCGG
TCCTCCCAGTCCATCGTG
CACTCCAACGGCAACACC
TACCTGGAATGGTATCAG
CAGAAGCCCGGCAAGGCC
CCTAAGCTGCTGATCTCC
AAGGTGTCCAACCGGTTC
TCCGGCGTGCCCTCCAGA
TTCTCCGGCTCTGGCTCT
GGCACCGACTTCACCCTG
ACCATCTCCAGCCTCCAG
CCCGAGGACTTCGCCACC
TACTACTGTTTTCAAGGC
TCCCACGTGCCCTTCACC
TTCGGCCAGGGCACCAAG
CTGGAAATCAAA
(nucleotides 58 to 393 of SEQ ID NO: 548)
[SEQ ID NO: 553]

DVQMTQSPSSLSASVGDR
VTITCRSSQSIVHSNGNT
YLEWYQQKPGKAPKLLIS
KVSNRFSGVPSRFSGSGS
GTDFTLTISSLQPEDFAT
YYCFQGSHVPFTFGQGTK
LEIK
[SEQ ID NO: 554]

CGAACTGTGGCTGCACCA
TCTGTCTTCATCTTCCCG
CCATCTGATGAGCAGTTG
AAATCTGGAACTGCCTCT
GTTGTGTGCCTGCTGAAT
AACTTCTATCCCAGAGAG
GCCAAAGTACAGTGGAAG
GTGGATAACGCCCTCCAA
TCGGGTAACTCCCAGGAG
AGTGTCACAGAGCAGGAC
AGCAAGGACAGCACCTAC
AGCCTCAGCAGCACGCTG
ACGCTGAGCAAAGCAGAC
TACGAGAAACACAAAGTC
TACGCCTGCGAAGTCACC
CATCAGGGCCTGAGCTCG
CCCGTCACAAAGAGCTTC
AACAGGGGAGAGTGT
(nucleotides 394 to 714 of SEQ ID NO: 548)
[SEQ ID NO: 555]

RTVAAPSVFIFPPSDEQL
KSGTASVVCLLNNFYPRE
AKVQWKVDNALQSGNSQE
SVTEQDSKDSTYSLSSTL
TLSKADYEKHKVYACEVT
HQGLSSPVTKSFNRGEC
[SEQ ID NO: 556]

TABLE 1-continued

| | | | |
|---|---|---|---|
| | Without leader [SEQ ID NO: 549]:<br>GACTGCAGATGACCAGTCCCT<br>TCCAGCCTGTCTGCCTCCGTGGGC<br>GACAGAGTGACCATCACCTGTCG<br>TCCTCCCAGTCCATCGTGCACTCC<br>AACGGCAACACCTACCTGAATGG<br>TATCAGCAGAAGCCCGGCAAGGCC<br>CCTAAGCTGCTGATCTCCAAGGTG<br>TCCAACCGGTTCTCCGGCGTGCCC<br>TCCAGATTCTCCGGCTCTGGCTCT<br>GGCACCGACTTCACCCTGACCATC<br>TCCAGCCTGCAGCCCGAGGACTTC<br>GCCACCTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTGAAATCTGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCAGCCTG<br>ACGCTGAGCAAAGCAGACTACGAG<br>AAACACAAAGTCTACGCCTGCGAA<br>GTCACCCATCACAGGGCCTGAGTCG<br>CCCGTCACAAAGAGCTTCAACAGG<br>GGAGAGTGTTGA | With leader [SEQ ID NO: 557]:<br>ATGGGCTGGTCCTGCATCATCCTG<br>TTTCTGGTGGCCACCGCCACCGGC<br>GTGCACAGCGACGTGCAGATGAC<br>CAGTCCCCTTCCAGCCTGTCTGCC<br>TCCGTGGGCGACAGAGTGACCATC<br>ACCTGTCGGTCCTCCCAGTCCATC<br>GTGCACTCCAACGGCAACACCTAC<br>CTGAACTGGTATCAGCAGAAGCCC<br>GGCAAGGCCCCTAAGCTGCTGATC<br>TCCAAGGTGTCCAACCGGTTCTCC<br>GGCGTGCCCTCCAGATTCTCCGGC<br>TCTGGCTCTGGCACCGACTTCACC<br>CTGACCATCTCCAGCCTGCAGCCC<br>GAGGACTTCGCCACCTACTACTGT<br>TTTCAAGGCTCCCACGTGCCCTTC<br>ACCTTCGGCCAGGGCACCAAGCTG<br>GAAATCAAACGAACTGTGGCTGCA<br>CCATCTGTCTTCATCTTCCCGCCA<br>TCTGATGAGCAGTTGAAATCTGAA<br>ACTGCCTCTGTTGTGTGCCTGCTG | With leader [SEQ ID NO: 557]:<br>ATGGGCTG<br>GTCCTGCA<br>TCATCCTG<br>TTTCTGGT<br>GGCCACCG<br>CCACCGGC<br>GTGCACAG<br>C (nucleotides<br>1 to 57 of<br>SEQ ID<br>NO: 557)<br>[SEQ ID<br>NO: 561] | GACGTGCAGATGACCCAG<br>TCCCCTTCCAGCCTGTCT<br>GCCTCCGTGGGCGACAGA<br>GTGACCATCACCTGTCGG<br>TCCTCCCAGTCCATCGTG<br>CACTCCAACGGCAACACC<br>TACCTGAACTGGTATCAG<br>CAGAAGCCCGGCAAGGCC<br>CCTAAGCTGCTGATCTCC<br>AAGGTGTCCAACCGGTTC<br>TCCGGCGTGCCCTCCAGA<br>TTCTCCGGCTCTGGCTCT<br>GGCACCGACTTCACCCTG<br>ACCATCTCCAGCCTGCAG<br>CCCGAGGACTTCGCCACC<br>TACTACTGTTTTCAAGGC<br>TCCCACGTGCCCTTCACC<br>TTCGGCCAGGGCACCAAG<br>CTGAAATCAAA<br>(nucleotides 58 to<br>393 of SEQ ID NO:<br>557) | CGAACTGTGGCTGCACCA<br>TCTGTCTTCATCTTCCCG<br>CCATCTGATGAGCAGTTG<br>AAATCTGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTGAGCAGCAGCCTG<br>ACGCTGAGCAAAGCAGAC<br>TACGAGAAACACAAAGTC<br>TACGCCTGCGAAGTCACC<br>CATCAGGGCCTGAGTCG<br>CCCGTCACAAAGAGCTTC<br>AACAGGGGAGAGTGTTGA<br>(nucleotides 394<br>to 714 of SEQ ID<br>NO: 557)<br>[SEQ ID NO: 564] |
| 7G6-<br>LCzu17 | | Without leader [SEQ ID NO: 560]:<br>DVQMTQSPSSLSASVGDRVTIT<br>CRSSQSIVHSNGNTYLNWYQQK<br>PGKAPKLLISKVSNRFSGVPSR<br>FSGSGSGTDFTLTISSLQPEDF<br>ATYYCFQGSHVPFTFGQGTKLE<br>IKRTVAAPSVFIFPPSDEQLKS<br>GTASVVCLLNNFYPREAKVQWK | With leader [SEQ ID NO: 559]:<br>MGWSCIILFLVATATGVHSDVQ<br>MTQSPSSLSASVGDRVTITCRS<br>SQSIVHSNGNTYLNWYQQKPGK<br>APKLLISKVSNRFSGVPSRFSG<br>SGSGTDFTLTISSLQPEDFATY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC | |

TABLE 1-continued

| | | | |
|---|---|---|---|
| | AATAACTTCTATCCAGAGAGGCC<br>AAAGTACAGTGGAAGGTGGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACGCTGAGCAAAGCA<br>GACTACGAGAAACACAAAGTCTAC<br>GCCTGCGAAGTCACCCATCAGGGC<br>CTGAGCTCGCCCGTCACAAAGAGC<br>TTCAACAGGGGAGAGTGTTGA<br>Without leader [SEQ ID<br>NO: 558]:<br>GACGTGCAGATGACCCAGTCCCCT<br>TCCAGCCTGTCTGCCTCCGTGGGC<br>GACAGAGTGACCATCACCTGTCGG<br>TCCTCCCAGTCCATCGTGCACTCC<br>AACGGCAACACCTACCTGAACTGG<br>TATCAGCAGAAGCCCGGCAAGGCC<br>CCTAAGCTGCTGATCTCCAAGGTG<br>TCCAACCGGTTCTCCGGCGTGCCC<br>TCCAGATTCTCCGGCTCTGGCTCT<br>GGCACCGACTTCACCCTGACCATC<br>TCCAGCCTCCAGCCTGAGGACTTC<br>GCCACCTACTACTGTTTTCAAGGC<br>TCCCACGTGCCCTTCACCTTCGGC<br>CAGGGCACCAAGCTGGAAATCAAA<br>CGAACTGTGGCTGCCACCATCGTC<br>TTCATCTTCCCGCCATCTGATGAG<br>CAGTTGAAATCTGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCACCCTG<br>ACGCTGAGCAAAGCAGACTACGAG<br>AAACACAAAGTCTACGCCTGCGAA<br>GTCACCCATCAGGGCCTGAGCTCG<br>CCCGTCACAAAGAGCTTCAACAGG<br>GGAGAGTGTTGA | VDNALQSGNSQESVTEQDSKDS<br>TYSLSSTLTLSKADYEKHKVYA<br>CEVTHQGLSSPVTKSFNRGEC | RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 565] |
| | | [SEQ ID NO: 562]<br>DVQMTQSPSSLSASVGDR<br>VTITCRSSQSIVHSNGNT<br>YLNWYQQKPGKAPKLLIS<br>KVSNRFSGVPSRFSGSGS<br>GTDFTLTISSLQPEDFAT<br>YYCFQGSHVPFTFGQGTK<br>LEIK<br>[SEQ ID NO: 563] | |
| 7G6-<br>LCzu18 | With leader [SEQ ID NO: 566]:<br>ATGGGCTGGTCCTGCATCATCCTG<br>TTTCTGGTGGCCACCGCCACCGGC<br>GTGCACAGCGATATCCAGATGACC<br>CAGTCCCCTTCCAGCCTGTCCGCC<br>TCTGTGGGCGACAGAGTGACCATC<br>ACCTGTCGTCCTCCAGTCCATC<br>GTGCACTCCAACGGCAACACCTAC<br>CTGAATGGTATCAGCAGAAGCCC<br>GGCAAGGCCCCTAAGCTGCTGATC<br>TCCAAGGTGTCCAACCGGTTCTCC | With leader [SEQ ID NO: 566]:<br>MGWSCIILFLVATATGVHSDIQ<br>MTQSPSSLSASVGDRVTITCRS<br>SQSIVHSNGNTYLEWYQQKPGK<br>APKLLISKVSNRFSGVPSRFSG<br>SGSGTDFTLTISSLQPEDFATY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV | ATGGGCTG<br>GTCCTGCA<br>TCATCCTG<br>TTTCTGGT<br>GGCCACCG<br>CCACCGGC<br>GTGCACAG<br>C (nucleotides<br>1 to 57 of<br>SEQ ID | GATATCCAGATGACCCAG<br>TCCCCTTCCAGCCTGTCC<br>GCCTCTGTGGGCGACAGA<br>GTGACCATCACCTGTCGG<br>TCCTCCCAGTCCATCCTG<br>CACTCCAACGGCAACACC<br>TACCTGAATGGTATCAG<br>CAGAAGCCCGGCAAGGCC<br>CCTAAGCTGCTGATCTCC<br>AAGGTGTCCAACCGGTTC<br>TCCGGCGTGCCCTCCAGA<br>TTCTCCGGCTCTGGCTCT | CGAACTGTGGCTGCCACCA<br>TCTGTCTTCATCTTCCCG<br>CCATCTGATGAGCAGTTG<br>AAATCTGGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG |

TABLE 1-continued

| | | |
|---|---|---|
| GGCCTGCCCTCCAGATTCTCCGGC<br>TCTGGCTCTGGCACCGACTTCACC<br>CTGACCATTCGCCACCTCCAGCCC<br>GAGGACTTCGCCACCTACTACTGT<br>TTTCAAGGCTCCCACGTGCCCTTC<br>ACCTTCGGCCAGGGCACCAAGCTG<br>GAAATCAAACGAACTGTGCCTGCA<br>CCATCTGTCTTCATCTTCCCGCCA<br>TCTGATGAGCAGTTGAAATCTGGA<br>ACTGCCTCTGTTGTGTGCCTGCTG<br>AATAACTTCTACCCAAGAGAGCC<br>AAAGTACAGTGGAAGGTGGATAAC<br>GCCCTCCAATCGGGTAACTCCCAG<br>GAGAGTGTCACAGAGCAGGACAGC<br>AAGGACAGCACTACAGCCTGAGC<br>AGCACCCTGACGCTGAGCAAAGCA<br>GACTACGAGAAACAAAGTCTAC<br>GCCTGCGAAGTCACCCATCAGGGC<br>CTGAGCTCGCCCGTCACAAAGAGC<br>TTCAACAGGGGAGAGTGTTGA<br>Without leader [SEQ ID<br>NO: 567]:<br>GATATCCAGATGACCCAGTCCCCT<br>TCCAGCCTGTCCGCCTCTGTGGGC<br>GACAGAGTGACCATCACCTGTCG<br>TCCTCCCAGTCCATCCTGCACTCC<br>AACGGCAACACCTACCTGGAATGG<br>TATCAGCAGAAGCCGGCAAGGCC<br>CCTAAGCTGCTGATCTCCAAGGTG<br>TCCAACCGGTTCTCCGGCGTGCCC<br>TCCAGATTCTCCGGCTCTGGCTCT<br>GGCACCGACTTCACCCTGACCATC<br>TCCAGCCTCCAGCCCGAGGACTTC<br>GCCACCTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGGAACTGCCTCT<br>GTTGTGTGCCTGCTGAATAACTTC<br>TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCACCCTG<br>ACGCTGAGCAAAGCAGACTACGAG<br>AAACACAAAGTCTACGCCTGCGAA<br>GTCACCCATCAGGGCCTGAGCTCG<br>CCCGTCACAAAGAGCTTCAACAGG<br>GGAGAGTGTTGA | THQGLSSPVTKSFNRGEC<br>Without leader [SEQ ID<br>NO: 569]:<br>DIQMTQSPSSLSASVGDRVTIT<br>CRSSQSILHSNGNTYLEWYQQK<br>PGKAPKLLISKVSNRFSGVPSR<br>FSGSGSGTDFTLTISSLQPEDF<br>ATYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | NO: 566)<br>[SEQ ID<br>NO: 570] | GGCACCGACTTCACCCTG<br>ACCATCTCCAGCCTCCAG<br>CCCGAGGACTTCGCCACC<br>TACTACTGTTTTCAAGGC<br>TCCCACGTGCCCTTCACC<br>TTCGGCCAGGGCACCAAG<br>CTGGAAATCAAA<br>(nucleotides 58 to<br>393 of SEQ ID NO:<br>566)<br>[SEQ ID NO: 571]<br>DIQMTQSPSSLSASVGDR<br>VTITCRSSQSILHSNGNT<br>YLEWYQQKPGKAPKLLIS<br>KVSNRFSGVPSRFSGSGS<br>GTDFTLTISSLQPEDFAT<br>YYCFQGSHVPFTFGQGTK<br>LEIK<br>[SEQ ID NO: 572] | ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGTTGA<br>(nucleotides 394<br>to 714 of SEQ ID<br>NO: 566) [SEQ ID<br>NO: 573]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 574] |

TABLE 1-continued

| | | | |
|---|---|---|---|
| 7G6-LCzu21 | With leader [SEQ ID NO: 575]:<br>ATGGGCTGCTGCTGCATCATCCTG<br>TTTCTGGTGCCACGCCACCGGC<br>GTGCACAGCGACTCGTGATGACA<br>CAGTCCCCCCTGTCCCTGCCTGTG<br>ACCCTGGGACAGCCTGCCTCCATC<br>TCCTGCAGATCCTCCAGTCCATC<br>CTGCACTCCAACGGCAACACCTAC<br>CTGGAATGGTCCAGCAGCCTCT<br>GGCCAGTCCCCCAGACTGCTGATC<br>TCCAAGGTGTCCAACCGGTTCTCC<br>GGCGTGCCCGACAGATTCTCCGGC<br>TCTGGCTCCGGCACCGACTTCACC<br>CTGAAGATCTCCCGGGTGGAAGCC<br>GAGGACGTGGGCGTGTACTACTGT<br>TTTCAAGGCTCCCACGTGCCCTTC<br>ACCTTCGGCCAGGGCACCAAGCTG<br>GAAATCAAACGAACTGTGGCTGCA<br>CCATCTGTCTTCATCTTCCCGCCA<br>TCTGATGAGCAGTTGAAATCTGGA<br>ACTGCCTCTGTTGTGCCTGCTG<br>AATAACTTCTATCCCAGAGAGGCC<br>AAAGTACAGTGGAAGGTGGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACCCTGAGCAAAGCA<br>GACTACGAGAAACACAAAGTCTAC<br>GCCTGCGAAGTCACCCATCAGGGC<br>CTGAGCTCCCCGTCACAAAGAGC<br>TTCAACAGGGGAGAGTGTTGA<br>Without leader [SEQ ID NO: 576]:<br>GACGTCGTGATGACACAGTCCCCC<br>CTGTCCCTGCCTGTGACCCTGGGA<br>CAGCCTGCCTCCATCTCCTGCAGA<br>TCCTCCCAGTCCATCCTGCACTCC<br>AACGGCAACACCTACCTGGAATGG<br>TTCCAGCAGCCGCCTGGCCAGTCC<br>CCCAGACTGCTGATCTCCAAGGTG<br>TCCAACCGGTTCTCCGGCGTGCCC<br>GACAGATTCTCCGGCTCTGGCTCT<br>GGCACCGACTTCACCCTGAAGATC<br>TCCCGGGTGGAAGCCGAGGACGTG<br>GGCGTGTACTACTGTTTTCAAGGC<br>TCCCACGTGCCCTTCACCTTCGGC<br>CAGGGCACCAAGCTGGAAATCAAA<br>CGAACTGTGGCTGCACCATCTGTC<br>TTCATCTTCCCGCCATCTGATGAG<br>CAGTTGAAATCTGGAACTGCCTCT<br>GTTGTGTGCCTGCTGAATAACTTC | With leader [SEQ ID NO: 577]:<br>MGWSCIILFLVATATGVHSDVV<br>MTQSPLSLPVTLGQPASISCRS<br>SQSILHSNGNTYLEWFQQRPGQ<br>SPRLLISKVSNRFSGVPDRFSG<br>SGSGTDFTLKISRVEAEDVGVY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC<br>Without leader [SEQ ID NO: 578]:<br>DVVMTQSPLSLPVTLGQPASIS<br>CRSSQSILHSNGNTYLEWFQQR<br>PGQSPRLLISKVSNRFSGVPDR<br>FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | ATGGGCTG<br>GTCCTGCA<br>TCATCCTG<br>TTTCTGGT<br>GGCCACCG<br>CCACCGGC<br>GTGCACAG<br>C (nucleotides 1 to 57 of SEQ ID NO: 575)<br>[SEQ ID NO: 579] | GACTCGTGATGACACAG<br>TCCCCCCTGTCCCTGCCT<br>GTGACCCTGGGACAGCCT<br>GCCTCCATCTCCTGCAGA<br>TCCTCCCAGTCCATCCTG<br>CACTCCAACGGCAACACC<br>TACCTGGAATGGTTCCAG<br>CAGCCGCCTGGCCAGTCC<br>CCCAGACTGCTGATCTCC<br>AAGGTGTCCAACCGGTTC<br>TCCGGCGTGCCCGACAGA<br>TTCTCCGGCTCTGGCTCT<br>GGCACCGACTTCACCCTG<br>AAGATCTCCCGGGTGGAA<br>GCCGAGGACGTGGGCGTG<br>TACTACTGTTTTCAAGGC<br>TCCCACGTGCCCTTCACC<br>TTCGGCCAGGGCACCAAG<br>CTGGAAATCAAA<br>(nucleotides 58 to 393 of SEQ ID NO: 575)<br>[SEQ ID NO: 580]<br>DVVMTQSPLSLPVTLGQP<br>ASISCRSSQSILHSNGNT<br>YLEWFQQRPGQSPRLLIS<br>KVSNRFSGVPDRFSGSGS<br>GTDFTLKISRVEAEDVGV<br>YYCFQGSHVPFTFGQGTK<br>LEIK<br>[SEQ ID NO: 581] | CGAACTGTGGCTGCACCA<br>TCTGTCTTCATCTTCCCG<br>CCATCTGATGAGCAGTTG<br>AAATCTGGAACTGCCTCT<br>GTTGTGTGCCTGCTGAAT<br>AACTTCTATCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGT<br>(nucleotides 394 to 714 of SEQ ID NO: 575)<br>[SEQ ID NO: 582]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 583] |

TABLE 1-continued

| | | |
|---|---|---|
| | TATCCCAGAGAGGCCAAAGTACAG<br>TGGAAGGTGGATAACGCCCTCCAA<br>TCGGGTAACTCCCAGGAGAGTGTC<br>ACAGAGCAGGACAGCAAGGACAGC<br>ACCTACAGCCTCAGCAGCACCCTG<br>ACCCTGAGCAAAGTCAGACTCGAG<br>AAACACAAAGTCTACGCCTGCGAA<br>GTCACCCATCAGGGCCTGAGCTCG<br>CCCGTCACAAAGAGCTTCAACAGG<br>GGAGAGTGTTGA | | |
| 7G6-<br>LCzu22 | With leader [SEQ ID NO:<br>584]:<br>ATGGGCTGGTCCTGCATCATCCTG<br>TTTCTGGTCGCCACGGCCACCGGC<br>GTGCACAGCGACGTCGTGATGACA<br>CAGTCCCCCCTGTCCCTGCCTGTG<br>ACAGGCCAGCCTGCCTCCATC<br>TCCTGCAGATCTCCCAGTCCATC<br>CTGCACTCCAACGGCAACACCTAC<br>CTGGAATGGTATCAGCAGCGGCCT<br>GGCCAGTCCCCCAGACGGCTGATC<br>TCCAAGGTGTCAACCGGTTCTCT<br>GGCGTGCCCGACAGATTCTCCGGC<br>TCTGGCTCTGGCACCGACTTCACC<br>CTGAAGATCTCCCGGGTGGAAGCC<br>GAGGACGTGGGCGTGTACTACTGT<br>TTTCAAGGTCCCACGTGCCCTTC<br>ACCTTCGGCCAGGGCACCAAGCTG<br>GAAATCAAACGAACTGTGGCTGCA<br>CCATCTGTCTTCATCTTCCCGCA<br>TCTGATGAGCAGTTGAAATCTGGA<br>ACTGCCTCTGTTGTGTGCCTGCTG<br>AATAACTTCTATCCCAGAGAGGCC<br>AAAGTACAGTGGAAGGTGGATAAC<br>GCCCTCCAATCGGGTAACTCCCAG<br>GAGAGTGTCACAGAGCAGGACAGC<br>AAGGACAGCACCTACAGCCTCAGC<br>AGCACCCTGACCCTGAGCAAAGCA<br>GACTACGAGAAACAAAGTCTAC<br>GCCTGCGAAGTCACCCATCAGGGC<br>CTGAGCTCGCCCGTCACAAAGAGC<br>TTCAACAGGGGAGAGTGTTGA<br>Without leader [SEQ ID<br>NO: 585]:<br>GACGTCGTGATGACACAGTCCCCC<br>CTGTCCCTGCCTGTGACAGGCCCT<br>GCCTCCATCTCCTGCAGA<br>TCTCCCAGTCCATCCTGCACTCC<br>AACGGCAACACCTACCTGGAATGG<br>TATCAGCAGCGGCCTGGCCAGTCC<br>CCCAGACGGCTGATCTCCAAGGTG<br>TCCAACCGGTTCTCTGGCGTGCCC | With leader [SEQ ID<br>NO: 586]:<br>MGWSCIILFLVATATGVHSDVV<br>MTQSPLSLPVTLGQPASISCRS<br>SQSILHSNGNTYLEWYQQRPGQ<br>SPRRLISKVSNRFSGVPDRFSG<br>SGSGTDFTLKISRVEAEDVGVY<br>YCFQGSHVPFTFGQGTKLEIKR<br>TVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEV<br>THQGLSSPVTKSFNRGEC [SEQ ID<br>NO: 587]:<br>DVVMTQSPLSLPVTLGQPASIS<br>CRSSQSILHSNGNTYLEWYQQR<br>PGQSPRRLISKVSNRFSGVPDR<br>FSGSGSGTDFTLKISRVEAEDV<br>GVYYCFQGSHVPFTFGQGTKLE<br>IKRTVAAPSVFIFPPSDEQLKS<br>GTASVVCLLNNFYPREAKVQWK<br>VDNALQSGNSQESVTEQDSKDS<br>TYSLSSTLTLSKADYEKHKVYA<br>CEVTHQGLSSPVTKSFNRGEC | ATGGGCTG<br>GTCCTGCA<br>TCATCCTG<br>TTTCTGGT<br>GGCCACCG<br>CCACCGGC<br>GTGCACAG<br>C<br>(nucleotides<br>1<br>to 57 of<br>SEQ ID<br>NO: 584)<br>[SEQ ID<br>NO: 588] | GACGTCGTGATGACACAG<br>TCCCCCCTGTCCCTGCCT<br>GTGACAGGCCCTGCCT<br>GCCTCCATCTCCTGCAGA<br>TCTCCCAGTCCATCCTG<br>CACTCCAACGGCAACACC<br>TACCTGGAATGGTATCAG<br>CAGCGGCCTGGCCAGTCC<br>CCCAGACGGCTGATCTCC<br>AAGGTGTCAACCGGTTC<br>TCTGGCGTGCCCGACAGA<br>TTCTCCGGCTCTGGCTCT<br>GGCACCGACTTCACCCTG<br>AAGATCTCCCGGGTGGAA<br>GCCGAGGACGTGGGCGTG<br>TACTACTGTTTTCAAGGC<br>TCCCACGTGCCCTTCACC<br>TTCGGCCAGGGCACCAAG<br>CTGGAAATCAAA<br>(nucleotides 58 to<br>393 of SEQ ID NO:<br>584)<br>[SEQ ID NO: 589]<br>DVVMTQSPLSLPVTLGQP<br>ASISCRSSQSILHSNGNT<br>YLEWYQQRPGQSPRRLIS<br>KVSNRFSGVPDRFSGSGS<br>GTDFTLKISRVEAEDVGV<br>YYCFQGSHVPFTFGQGTK<br>LEIK<br>[SEQ ID NO: 590] | CGAACTGTGGCTGCACCA<br>TCTGTCTTCATCTTCCCG<br>CCATCTGATGAGCAGTTG<br>AAATCTGGAACTGCCTCT<br>GTTGTGTGCCTGCTGAAT<br>AACTTCTATCCCAGAGAG<br>GCCAAAGTACAGTGGAAG<br>GTGGATAACGCCCTCCAA<br>TCGGGTAACTCCCAGGAG<br>AGTGTCACAGAGCAGGAC<br>AGCAAGGACAGCACCTAC<br>AGCCTCAGCAGCACCCTG<br>ACGCTGAGCAAAGCAGAC<br>TACGAGAAACACAAAGTC<br>TACGCCTGCGAAGTCACC<br>CATCAGGGCCTGAGCTCG<br>CCCGTCACAAAGAGCTTC<br>AACAGGGGAGAGTGT<br>(nucleotides 394<br>to 714 of SEQ ID<br>NO: 584)<br>[SEQ ID NO: 591]<br>RTVAAPSVFIFPPSDEQL<br>KSGTASVVCLLNNFYPRE<br>AKVQWKVDNALQSGNSQE<br>SVTEQDSKDSTYSLSSTL<br>TLSKADYEKHKVYACEVT<br>HQGLSSPVTKSFNRGEC<br>[SEQ ID NO: 592] |

TABLE 1-continued

```
GACAGATTCTCCGGCTCTGGCTCT
GGCACCGACTTCACCCTGAAGATC
TCCCGGGTGGAAGCCGAGACGTG
GGCGTGTACTACTGTTTCAAGGC
TCCCACGTGCCCTTCACCTTCGGC
CAGGGCACCAAGCTGGAAATCAAA
CGAACTGTGGCTGCACCATCTGTC
TTCATCTTCCCGCCATCTGATGAG
CAGTTGAAATCTGGCTGAATAACTTC
GTTTGTGTGCCTGCTGAATAACTTC
TATCCAGAGGACCAAAGTACAG
TGGAAGGTGGATAACGCCCCTCCAA
TCGGGTACTCCCAGGAGAGTGTC
ACAGAGCAGGACAGCAAGGACAGC
ACCTACAGCCTCAGCAGCACCCTG
ACGCTGAGCAAAGCAGACTACGAG
AAACACAAAGTTACGCCTGCGAA
GTCACCCATCAGGGCCTGAGCTCG
CCCGTCACAAAGAGCTTCAACAGG
GGAGAGTGTTGA
```

| Clone Name (Species & Isotype) | VH CDR1 DNA Sequence | VH CDR1 Amino Acid Sequence | VH CDR2 DNA Sequence | VH CDR2 Amino Acid Sequence | VH CDR3 DNA Sequence | VH CDR3 Amino Acid Sequence |
|---|---|---|---|---|---|---|
| | | | 7G6 VH numbered according to Kabat | | | |
| mouse 7G6-Vh | ACCTACTGGATA ACC [SEQ ID NO: 593] | TYWIT [SEQ ID NO: 594] | GATATTTATCCTGGTAGTAGTA TTTGTAACTACAATGAGAAGTT CAAGAGC [SEQ ID NO: 595] | DIYPGSSICNYNEK FKS [SEQ ID NO: 596] | GAGGATGGTTACGACGCCTTGGTTT GCTTAC [SEQ ID NO: 597] | EDGYDAWF AY [SEQ ID NO: 598] |
| 7G6-HCzu1 | ACCTACTGGATC ACC [SEQ ID NO: 599] | TYWIT [SEQ ID NO: 600] | GACATCTACCCCGGCTCCTCCA TCTGCAACTACAACGAGAAGTT CAAGTCC [SEQ ID NO: 601] | DIYPGSSICNYNEK FKS [SEQ ID NO: 602] | GAGGACGGCTACGACGCCTTGGTTT GCCTAC [SEQ ID NO: 603] | EDGYDAWF AY [SEQ ID NO: 604] |
| 7G6-HCzu2 | ACCTACTGGATC ACC [SEQ ID NO: 605] | TYWIT [SEQ ID NO: 606] | GACATCTACCCCGGCTCCTCCA TCTGCAACTACAACGAGAAGTT CAAGTCC [SEQ ID NO: 607] | DIYPGSSICNYNEK FKS [SEQ ID NO: 608] | GAGGACGGCTACGACGCCTTGGTTT GCCTAC [SEQ ID NO: 609] | EDGYDAWF AY [SEQ ID NO: 610] |
| 7G6-HCzu3 | ACCTACTGGATC ACC [SEQ ID NO: 611] | TYWIT [SEQ ID NO: 612] | GACATCTACCCCGGCTCCTCCA TCTGCAACTACAACGAGAAGTT CAAGTCC [SEQ ID NO: 613] | DIYPGSSICNYNEK FKS [SEQ ID NO: 614] | GAGGACGGCTACGACGCCTTGGTTT GCCTAC [SEQ ID NO: 615] | EDGYDAWF AY [SEQ ID NO: 616] |
| 7G6-HCzu4 | ACCTACTGGATC ACC [SEQ ID NO: 617] | TYWIT [SEQ ID NO: 618] | GACATCTACCCCGGCTCCTCCA TCTGCAACTACGCCCAGAAATT CCAGGGC [SEQ ID NO: 619] | DIYPGSSICNYAQK FQG [SEQ ID NO: 620] | GAGGACGGCTACGACGCCTTGGTTT GCCTAC [SEQ ID NO: 621] | EDGYDAWF AY [SEQ ID NO: 622] |

TABLE 1-continued

| | | | |
|---|---|---|---|
| 7G6-HCzu5 | ACCTACTGGATCACC [SEQ ID NO: 623] | GACATCTACCCCGGCTCCTCCATCTCCAACTACAACGAGAAGTTCAAGTCC [SEQ ID NO: 625] | GAGGACGGCTACGACGCTTGGTTTGCCTAC [SEQ ID NO: 627] |
| | TYWIT [SEQ ID NO: 624] | DIYPGSSISNYNEKFKS [SEQ ID NO: 626] | EDGYDAWFAY [SEQ ID NO: 628] |
| 7G6-HCzu6 | ACCTACTGGATCACC [SEQ ID NO: 629] | GACATCTACCCCGGCTCCTCCATCTCCAACTACAACGAGAAGTTCAAGTCC [SEQ ID NO: 631] | GAGGACGGCTACGACGCTTGGTTTGCCTAC [SEQ ID NO: 633] |
| | TYWIT [SEQ ID NO: 630] | DIYPGSSISNYNEKFKS [SEQ ID NO: 632] | EDGYDAWFAY [SEQ ID NO: 634] |
| 7G6-HCzu7 | ACCTACTGGATCACC [SEQ ID NO: 635] | GACATCTACCCCGGCTCCTCCATCTGCAACTACGCCCAGAAGTTCCAGGGC [SEQ ID NO: 637] | GAGGACGGCTACGACGCTTGGTTTGCCTAC [SEQ ID NO: 639] |
| | TYWIT [SEQ ID NO: 636] | DIYPGSSISNYAQKFQG [SEQ ID NO: 638] | EDGYDAWFAY [SEQ ID NO: 640] |
| 7G6-HCzu8 | ACCTACTGGATCACC [SEQ ID NO: 641] | GACATCTACCCCGGCTCCTCCATCTCCAACTACGCCCAGAAGTTCCAGGGC [SEQ ID NO: 643] | GAGGACGGCTACGACGCTTGGTTTGCCTAC [SEQ ID NO: 645] |
| | TYWIT [SEQ ID NO: 642] | DIYPGSSISNYAQKFQG [SEQ ID NO: 644] | EDGYDAWFAY [SEQ ID NO: 646] |
| 7G6-HCzu9 | ACCTACTGGATCACC [SEQ ID NO: 647] | GACATCTACCCCGGCTCCTCCATCTGCAACTACGCCCAGAAGTTCCAGGGC [SEQ ID NO: 649] | GAGGACGGCTACGACGCTTGGTTTGCCTAC [SEQ ID NO: 651] |
| | TYWIT [SEQ ID NO: 648] | DIYPGSSICNYAQKFQG [SEQ ID NO: 650] | EDGYDAWFAY [SEQ ID NO: 652] |
| 7G6-HCzu10 | ACCTACTGGATCACC [SEQ ID NO: 653] | GACATCTACCCCGGCTCCTCCATCTGCAACTACGCCCAGAAGTTCCAGGGC [SEQ ID NO: 655] | GAGGACGGCTACGACGCTTGGTTTGCCTAC [SEQ ID NO: 657] |
| | TYWIT [SEQ ID NO: 654] | DIYPGSSICNYAQKFQG [SEQ ID NO: 656] | EDGYDAWFAY [SEQ ID NO: 658] |
| 7G6-HCzu11 | ACCTACTGGATCACC [SEQ ID NO: 659] | GACATCTACCCCGGCTCCTCCATCTGCAACTACAACGAGAAGTTCAAGTCC [SEQ ID NO: 661] | GAGGACGGCTACGACGCTTGGTTTGCCTAC [SEQ ID NO: 663] |
| | TYWIT [SEQ ID NO: 660] | DIYPGSSICNYNEKFKS [SEQ ID NO: 662] | EDGYDAWFAY [SEQ ID NO: 664] |
| 7G6-HCzu12 | ACCTACTGGATCACC [SEQ ID NO: 665] | GACATCTACCCCGGCTCCTCCATCTGCAACTACAACGAGAAGTTCAAGTCC [SEQ ID NO: 667] | GAGGACGGCTACGACGCTTGGTTTGCTTAC [SEQ ID NO: 669] |
| | TYWIT [SEQ ID NO: 666] | DIYPGSSICNYNEKFKS [SEQ ID NO: 668] | EDGYDAWFAY [SEQ ID NO: 670] |
| 7G6-HCzu13 | ACCTACTGGATCACC [SEQ ID NO: 671] | GACATCTACCCCGGCTCCTCCATCTGCAACTACGCCGACTCCGT [SEQ ID NO: 673] | GAGGACGGCTACGACGCTTGGTTTGCTTAC [SEQ ID NO: 675] |
| | TYWIT [SEQ ID NO: 672] | DIYPGSSICNYADSVKG [SEQ ID NO: 674] | EDGYDAWFAY [SEQ ID NO: 676] |
| 7G6-HCzu14 | ACCTACTGGATCACC [SEQ ID NO: 677] | GACATCTACCCCGGCTCCTCCATCTGCAACTACGCCGACAAGTTCAAGGGC [SEQ ID NO: 679] | GAGGACGGCTACGACGCTTGGTTTGCTTAC [SEQ ID NO: 681] |
| | TYWIT [SEQ ID NO: 678] | DIYPGSSICNYADKFKG [SEQ ID NO: 680] | EDGYDAWFAY [SEQ ID NO: 682] |
| 7G6-HCzu15 | ACCTACTGGATCACC | GACATCTACCCCGGCTCCTCCATCTGCAACTACAACGAGAAGTT | GAGGACGGCTACGACGCTTGGTTTGCTTAC |
| | TYWIT [SEQ | DIYPGSSICNYNEKFKS | EDGYDAWFAY |

TABLE 1-continued

| Clone Name (Species & Isotype) | VL CDR1 DNA Sequence | VL CDR1 Amino Acid Sequence | VL CDR2 DNA Sequence | VL CDR2 Amino Acid Sequence | VL CDR3 DNA Sequence | VL CDR3 Amino Acid Sequence |
|---|---|---|---|---|---|---|
| | [SEQ ID NO: 683] | TYWIT [SEQ ID NO: 684] | CAAGTCC [SEQ ID NO: 685] | | | [SEQ ID NO: 686] | [SEQ ID NO: 687] | [SEQ ID NO: 688] |
| 7G6-HCzu16 | ACCTACTGGATCACC [SEQ ID NO: 689] | TYWIT [SEQ ID NO: 690] | GACATCTACCCCGGCTCCTCCATCTGCAACTACAACGAGAAGTTCAAGTCC [SEQ ID NO: 691] | DIYPGSSICNYNEKFKS [SEQ ID NO: 692] | GAGGACGGCTACGACGCTTGGTTTGCTTAC [SEQ ID NO: 693] | EDGYDAWFAY [SEQ ID NO: 694] |
| 7G6-HCzu17 | ACCTACTGGATCACC [SEQ ID NO: 695] | TYWIT [SEQ ID NO: 696] | GACATCTACCCCGGCTCCTCCATCTGCAACTACAACGAGAAGTTCAAGTCC [SEQ ID NO: 697] | DIYPGSSICNYNEKFKS [SEQ ID NO: 698] | GAGGACGGCTACGACGCTTGGTTTGCTTAC [SEQ ID NO: 699] | EDGYDAWFAY [SEQ ID NO: 700] |
| 7G6-HCzu18 | ACCTACTGGATCACC [SEQ ID NO: 701] | TYWIT [SEQ ID NO: 702] | GACATCTACCCCGGCTCCTCCATCTGCAACTACAACGAGAAGTTCAAGTCC [SEQ ID NO: 703] | DIYPGSSICNYNEKFKS [SEQ ID NO: 704] | GAGGACGGCTACGACGCTTGGTTTGCTTAC [SEQ ID NO: 705] | EDGYDAWFAY [SEQ ID NO: 706] |
| 7G6-HCzu19 | ACCTACTGGATCACC [SEQ ID NO: 707] | TYWIT [SEQ ID NO: 708] | GACATCTACCCCGGCTCCTCCATCTGCAACTACCCCGACAAGTTCAAGGGC [SEQ ID NO: 709] | DIYPGSSICNYADKFKG [SEQ ID NO: 710] | GAGGACGGCTACGACGCTTGGTTTGCTTAC [SEQ ID NO: 711] | EDGYDAWFAY [SEQ ID NO: 712] |
| 7G6-HCzu20 | ACCTACTGGATCACC [SEQ ID NO: 713] | TYWIT [SEQ ID NO: 714] | GACATCTACCCCGGCTCCTCCATCTGCAACTACGCCGACAAGTTCAAGGGC [SEQ ID NO: 715] | DIYPGSSICNYADKFKG [SEQ ID NO: 716] | GAGGACGGCTACGACGCTTGGTTTGCTTAC [SEQ ID NO: 717] | EDGYDAWFAY [SEQ ID NO: 718] |
| 7G6-HCzu23 | ACCTACTGGATCACC [SEQ ID NO: 719] | TYWIT [SEQ ID NO: 720] | GACATCTACCCCGGCTCCTCCATCTCTAACTACGCCGACTCCGTCAAGGGC [SEQ ID NO: 721] | DIYPGSSISNYADSVKG [SEQ ID NO: 722] | GAGGACGGCTACGACGCTTGGTTTGCTTAC [SEQ ID NO: 723] | EDGYDAWFAY [SEQ ID NO: 724] |
| 7G6-HCzu24 | ACCTACTGGATCACC [SEQ ID NO: 725] | TYWIT [SEQ ID NO: 726] | GACATCTACCCCGGCTCCTCCATCTCCAACTACAACGAGAAGTTCAAGTCC [SEQ ID NO: 727] | DIYPGSSISNYNEKFKS [SEQ ID NO: 728] | GAGGACGGCTACGACGCTTGGTTTGCTTAC [SEQ ID NO: 729] | EDGYDAWFAY [SEQ ID NO: 730] |
| 7G6-HCzu25 | ACCTACTGGATCACC [SEQ ID NO: 731] | TYWIT [SEQ ID NO: 732] | GACATCTACCCCGGCTCCTCCATCTCCAACTACAACGAGAAGTTCAAGTCC [SEQ ID NO: 733] | DIYPGSSISNYNEKFKS [SEQ ID NO: 734] | GAGGACGGCTACGACGCTTGGTTTGCTTAC [SEQ ID NO: 735] | EDGYDAWFAY [SEQ ID NO: 736] |
| 7G6 VL numbered according to Kabat | | | | | | |
| mouse 7G6-Vk | AGATCTAGTCAGAGCATTTTACATAGTAATGGAAACACCT | RSSQSILHSNGNTYLE | AAAGTTTCCAACCG | KVSNRFS [SEQ ID] | TTTCAAGTTCACATGTTCCATTCACG | FQGSHVPFT |

TABLE 1-continued

| | | | | | |
|---|---|---|---|---|---|
| | ATTTAGAA [SEQ ID NO: 737] | [SEQ ID NO: 738] | [SEQ ID NO: 739] | [SEQ ID NO: 740] | [SEQ ID NO: 741] | [SEQ ID NO: 742] |
| 7G6-LCzu1 | AGATCCTCCCAGTCCATCCT GCACTCCAACGGCAACACCT ACCTGGAA [SEQ ID NO: 743] | RSSQSILHSNGNT YLE [SEQ ID NO: 744] | AAGGTGTCCAACCG GTTCTCC [SEQ ID NO: 745] | KVSNRFS [SEQ ID NO: 746] | TTTCAAGGCTCCCACGTGCCCT TCACC [SEQ ID NO: 747] | FQGSHVP FT [SEQ ID NO: 748] |
| 7G6-LCzu2 | AGATCCTCCCAGTCCATCCT GCACTCCAACGGCAACACCT ACCTGGAA [SEQ ID NO: 749] | RSSQSILHSNGNT YLE [SEQ ID NO: 750] | AAGGTGTCCAACCG GTTCTCC [SEQ ID NO: 751] | KVSNRFS [SEQ ID NO: 752] | TTTCAAGGCTCCCACGTGCCCT TCACC [SEQ ID NO: 753] | FQGSHVP FT [SEQ ID NO: 754] |
| 7G6-LCzu3 | AGATCCTCCCAGTCCATCCT GCACTCCAACGGCAACACCT ACCTGGAA [SEQ ID NO: 755] | RSSQSILHSNGNT YLE [SEQ ID NO: 756] | AAGGTGTCCAACCG GTTCTCC [SEQ ID NO: 757] | KVSNRFS [SEQ ID NO: 758] | TTTCAAGGCTCCCACGTGCCCT TCACC [SEQ ID NO: 759] | FQGSHVP FT [SEQ ID NO: 760] |
| 7G6-LCzu4 | AGATCCTCCCAGTCCATCCT GCACTCCAACGGCAACACCT ACCTGGAA [SEQ ID NO: 761] | RSSQSILHSNGNT YLE [SEQ ID NO: 762] | AAGGTGTCCAACCG GTTCTCT [SEQ ID NO: 763] | KVSNRFS [SEQ ID NO: 764] | TTTCAAGGCTCCCACGTGCCCT TCACC [SEQ ID NO: 765] | FQGSHVP FT [SEQ ID NO: 766] |
| 7G6-LCzu5 | AGATCCTCCCAGTCCATCCT GCACTCCAACGGCAACACCT ACCTGGAA [SEQ ID NO: 767] | RSSQSILHSNGNT YLE [SEQ ID NO: 768] | AAGGTGTCCAACCG GTTCTCC [SEQ ID NO: 769] | KVSNRFS [SEQ ID NO: 770] | TTTCAAGGCTCCCACGTGCCCT TCACC [SEQ ID NO: 771] | FQGSHVP FT [SEQ ID NO: 772] |
| 7G6-LCzu6 | AGATCCTCCCAGTCCATCCT GCACTCCAACGGCAACACCT ACCTGGAA [SEQ ID NO: 773] | RSSQSILHSNGNT YLE [SEQ ID NO: 774] | AAGGTGTCCAACCG GTTCTCC [SEQ ID NO: 775] | KVSNRFS [SEQ ID NO: 776] | TTTCAAGGCTCCCACGTGCCCT TCACC [SEQ ID NO: 777] | FQGSHVP FT [SEQ ID NO: 778] |
| 7G6-LCzu7 | AGATCCTCCCAGTCCATCCT GCACTCCAACGGCAACACCT ACCTGGAA [SEQ ID NO: 779] | RSSQSILHSNGNT YLE [SEQ ID NO: 780] | AAGGTGTCCAACCG GTTCTCC [SEQ ID NO: 781] | KVSNRFS [SEQ ID NO: 782] | TTTCAAGGCTCCCACGTGCCCT TCACC [SEQ ID NO: 783] | FQGSHVP FT [SEQ ID NO: 784] |
| 7G6-LCzu8 | AGATCCTCCCAGTCCATCGT GCACTCCAACGGCAACACCT ACCTGGAA [SEQ ID NO: 785] | RSSQSIVHSNGNT YLE [SEQ ID NO: 786] | AAGGTGTCCAACCG GTTCTCC [SEQ ID NO: 787] | KVSNRFS [SEQ ID NO: 788] | TTTCAAGGCTCCCACGTGCCCT TCACC [SEQ ID NO: 789] | FQGSHVP FT [SEQ ID NO: 790] |

TABLE 1-continued

| | | | | | | |
|---|---|---|---|---|---|---|
| 7G6-LCzu9 | AGATCCTCCCAGTCCATCGT GCACTCCAACGGCAACACCT ACCTGAAC [SEQ ID NO: 791] | RSSQSIVHSNGNT YLN [SEQ ID NO: 792] | AAGGTGTCCAACCG GTTCTCC [SEQ ID NO: 793] | KVSNRFS [SEQ ID NO: 794] | TTTCAAGGCTCCCACGTGCCCT TCACC [SEQ ID NO: 795] | FQGSHVP FT [SEQ ID NO: 796] |
| 7G6-LCzu10 | AGATCCTCCCAGTCCATCGT GCACTCCAACGGCAACACCT ACCTGGAA [SEQ ID NO: 797] | RSSQSIVHSNGNT YLE [SEQ ID NO: 798] | AAGGTGTCCAACCG GTTCTCC [SEQ ID NO: 799] | KVSNRFS [SEQ ID NO: 800] | TTTCAAGGCTCCCACGTGCCCT TCACC [SEQ ID NO: 801] | FQGSHVP FT [SEQ ID NO: 802] |
| 7G6-LCzu11 | CGGTCCTCCCAGTCCATCCT GCACTCCAACGGCAACACCT ACCTGGAA [SEQ ID NO: 803] | RSSQSILHSNGNT YLE [SEQ ID NO: 804] | AAGGTGTCCAACCG GTTCTCC [SEQ ID NO: 805] | KVSNRFS [SEQ ID NO: 806] | TTTCAAGGCTCCCACGTGCCCT TCACC [SEQ ID NO: 807] | FQGSHVP FT [SEQ ID NO: 808] |
| 7G6-LCzu12 | CGGTCCTCCCAGTCCATCCT GCACTCCAACGGCAACACCT ACCTGGAA [SEQ ID NO: 809] | RSSQSILHSNGNT YLE [SEQ ID NO: 810] | AAGGTGTCCAACCG GTTCTCC [SEQ ID NO: 811] | KVSNRFS [SEQ ID NO: 812] | TTTCAAGGCTCCCACGTGCCCT TCACC [SEQ ID NO: 813] | FQGSHVP FT [SEQ ID NO: 814] |
| 7G6-LCzu13 | CGGTCCTCCCAGTCCATCCT GCACTCCAACGGCAACACCT ACCTGGAA [SEQ ID NO: 815] | RSSQSILHSNGNT YLE [SEQ ID NO: 816] | AAGGTGTCCAACCG GTTCTCC [SEQ ID NO: 817] | KVSNRFS [SEQ ID NO: 818] | TTTCAAGGCTCCCACGTGCCCT TCACC [SEQ ID NO: 819] | FQGSHVP FT [SEQ ID NO: 820] |
| 7G6-LCzu14 | CGGTCCTCCCAGTCCATCCT GCACTCCAACGGCAACACCT ACCTGGAA [SEQ ID NO: 821] | RSSQSILHSNGNT YLE [SEQ ID NO: 822] | AAGGTGTCCAACCG GTTCTCC [SEQ ID NO: 823] | KVSNRFS [SEQ ID NO: 824] | TTTCAAGGCTCCCACGTGCCCT TCACC [SEQ ID NO: 825] | FQGSHVP FT [SEQ ID NO: 826] |
| 7G6-LCzu15 | CGGTCCTCCCAGTCCATCCT GCACTCCAACGGCAACACCT ACCTGGAA [SEQ ID NO: 827] | RSSQSILHSNGNT YLE [SEQ ID NO: 828] | AAGGTGTCCAACCG GTTCTCC [SEQ ID NO: 829] | KVSNRFS [SEQ ID NO: 830] | TTTCAAGGCTCCCACGTGCCCT TCACC [SEQ ID NO: 831] | FQGSHVP FT [SEQ ID NO: 832] |
| 7G6-LCzu16 | CGGTCCTCCCAGTCCATCGT GCACTCCAACGGCAACACCT ACCTGGAA [SEQ ID NO: 833] | RSSQSIVHSNGNT YLE [SEQ ID NO: 834] | AAGGTGTCCAACCG GTTCTCC [SEQ ID NO: 835] | KVSNRFS [SEQ ID NO: 836] | TTTCAAGGCTCCCACGTGCCCT TCACC [SEQ ID NO: 837] | FQGSHVP FT [SEQ ID NO: 838] |

TABLE 1-continued

| | VH CDR1 DNA Sequence | VH CDR1 Amino Acid Sequence | VH CDR2 DNA Sequence | VH CDR2 Amino Acid Sequence | VH CDR3 DNA Sequence | VH CDR3 Amino Acid Sequence |
|---|---|---|---|---|---|---|
| 7G6-LCzu17 | CGGTCCTCCCAGTCCATCGT GCACTCCAACGGCAACACCT ACCTGAAC [SEQ ID NO: 839] | RSSQSIVHSNGNT YLN [SEQ ID NO: 840] | AAGGTGTCCAACCG GTTCTCC [SEQ ID NO: 841] | KVSNRFS [SEQ ID NO: 842] | TTTCAAGGTCTCCCACGTGCCCT TCACC [SEQ ID NO: 843] | FQGSHVP FT [SEQ ID NO: 844] |
| 7G6-LCzu18 | CGGTCCTCCCAGTCCATCCT GCACTCCAACGGCAACACCT ACCTGGAA [SEQ ID NO: 845] | RSSQSILHSNGNT YLE [SEQ ID NO: 846] | AAGGTGTCCAACCG GTTCTCC [SEQ ID NO: 847] | KVSNRFS [SEQ ID NO: 848] | TTTCAAGGTCTCCCACGTGCCCT TCACC [SEQ ID NO: 849] | FQGSHVP FT [SEQ ID NO: 850] |
| 7G6-LCzu21 | AGATCCTCCCAGTCCATCCT GCACTCCAACGGCAACACCT ACCTGGAA [SEQ ID NO: 851] | RSSQSILHSNGNT YLE [SEQ ID NO: 852] | AAGGTGTCCAACCG GTTCTCC [SEQ ID NO: 853] | KVSNRFS [SEQ ID NO: 854] | TTTCAAGGTCTCCCACGTGCCCT TCACC [SEQ ID NO: 855] | FQGSHVP FT [SEQ ID NO: 856] |
| 7G6-LCzu22 | AGATCCTCCCAGTCCATCCT GCACTCCAACGGCAACACCT ACCTGGAA [SEQ ID NO: 857] | RSSQSILHSNGNT YLE [SEQ ID NO: 858] | AAGGTGTCCAACCG GTTCTCT [SEQ ID NO: 859] | KVSNRFS [SEQ ID NO: 860] | TTTCAAGGTCTCCCACGTGCCCT TCACC [SEQ ID NO: 861] | FQGSHVP FT [SEQ ID NO: 862] |

7G6 VH numbered according to IMGT

| Clone Name (Species & Isotype) | VH CDR1 DNA Sequence | VH CDR1 Amino Acid Sequence | VH CDR2 DNA Sequence | VH CDR2 Amino Acid Sequence | VH CDR3 DNA Sequence | VH CDR3 Amino Acid Sequence |
|---|---|---|---|---|---|---|
| mouse 7G6-Vh | GGCTACACCTTCA CCACTACTGG [SEQ ID NO: 863] | GYTFTTY W [SEQ ID NO: 864] | ATTTATCCTGGTAGTAGTATT TGT [SEQ ID NO: 865] | IYPGSS IC [SEQ ID NO: 866] | GCAAGGGAGGATGGTTACGACGCCT GGTTTGCTTAC [SEQ ID NO: 867] | AREDGYDAWFAY [SEQ ID NO: 868] |
| 7G6-HCzu1 | GGCTACACCTTTA CCACTACTGG [SEQ ID NO: 869] | GYTFTTY W [SEQ ID NO: 870] | ATCTACCCCGGCTCCTCCATC TGC [SEQ ID NO: 871] | IYPGSS IC [SEQ ID NO: 872] | GCTAGAGAGGACGGCTACGACGCTT GGTTTGCCTAC [SEQ ID NO: 873] | AREDGYDAWFAY [SEQ ID NO: 874] |
| 7G6-HCzu2 | GGCTACACCTTTA CCACTACTGG [SEQ ID NO: 875] | GYTFTTY W [SEQ ID NO: 876] | ATCTACCCCGGCTCCTCCATC TGC [SEQ ID NO: 877] | IYPGSS IC [SEQ ID NO: 878] | GCTAGAGAGGACGGCTACGACGCTT GGTTTGCCTAC [SEQ ID NO: 879] | AREDGYDAWFAY [SEQ ID NO: 880] |

TABLE 1-continued

| | | | | | |
|---|---|---|---|---|---|
| 7G6-HCzu3 | GGCTACACCTTTA CCACCTACTGG [SEQ ID NO: 881] | GYTFTTY W [SEQ ID NO: 882] | ATCTACCCCGGCTCCTCCATC TGC [SEQ ID NO: 883] | IYPGSS IC [SEQ ID NO: 884] | GCTAGAGAGGACGGCTACGACGCTT GGTTTGCCTAC [SEQ ID NO: 885] | AREDGYDAWFAY [SEQ ID NO: 886] |
| 7G6-HCzu4 | GGCTACACCTTTA CCACCTACTGG [SEQ ID NO: 887] | GYTFTTY W [SEQ ID NO: 888] | ATCTACCCCGGCTCCTCCATC TGC [SEQ ID NO: 889] | IYPGSS IC [SEQ ID NO: 890] | GCTAGAGAGGACGGCTACGACGCTT GGTTTGCCTAC [SEQ ID NO: 891] | AREDGYDAWFAY [SEQ ID NO: 892] |
| 7G6-HCzu5 | GGCTACACCTTTA CCACCTACTGG [SEQ ID NO: 893] | GYTFTTY W [SEQ ID NO: 894] | ATCTACCCCGGCTCCTCCATC TCC [SEQ ID NO: 895] | IYPGSS IS [SEQ ID NO: 896] | GCTAGAGAGGACGGCTACGACGCTT GGTTTGCCTAC [SEQ ID NO: 897] | AREDGYDAWFAY [SEQ ID NO: 898] |
| 7G6-HCzu6 | GGCTACACCTTTA CCACCTACTGG [SEQ ID NO: 899] | GYTFTTY W [SEQ ID NO: 900] | ATCTACCCCGGCTCCTCCATC TCC [SEQ ID NO: 901] | IYPGSS IS [SEQ ID NO: 902] | GCTAGAGAGGACGGCTACGACGCTT GGTTTGCCTAC [SEQ ID NO: 903] | AREDGYDAWFAY [SEQ ID NO: 904] |
| 7G6-HCzu7 | GGCTACACCTTTA CCACCTACTGG [SEQ ID NO: 905] | GYTFTTY W [SEQ ID NO: 906] | ATCTACCCCGGCTCCTCCATC TCC [SEQ ID NO: 907] | IYPGSS IS [SEQ ID NO: 908] | GCTAGAGAGGACGGCTACGACGCTT GGTTTGCCTAC [SEQ ID NO: 909] | AREDGYDAWFAY [SEQ ID NO: 910] |
| 7G6-HCzu8 | GGCTACACCTTTA CCACCTACTGG [SEQ ID NO: 911] | GYTFTTY W [SEQ ID NO: 912] | ATCTACCCCGGCTCCTCCATC TCC [SEQ ID NO: 913] | IYPGSS IS [SEQ ID NO: 914] | GCTAGAGAGGACGGCTACGACGCTT GGTTTGCCTAC [SEQ ID NO: 915] | AREDGYDAWFAY [SEQ ID NO: 916] |
| 7G6-HCzu9 | GGCTACACCTTTA CCACCTACTGG [SEQ ID NO: 917] | GYTFTTY W [SEQ ID NO: 918] | ATCTACCCCGGCTCCTCCATC TGC [SEQ ID NO: 919] | IYPGSS IC [SEQ ID NO: 920] | GCTAGAGAGGACGGCTACGACGCTT GGTTTGCCTAC [SEQ ID NO: 921] | AREDGYDAWFAY [SEQ ID NO: 922] |
| 7G6-HCzu10 | GGCTACACCTTTA CCACCTACTGG [SEQ ID NO: 923] | GYTFTTY W [SEQ ID NO: 924] | ATCTACCCCGGCTCCTCCATC TGC [SEQ ID NO: 925] | IYPGSS IC [SEQ ID NO: 926] | GCTAGAGAGGACGGCTACGACGCTT GGTTTGCCTAC [SEQ ID NO: 927] | AREDGYDAWFAY [SEQ ID NO: 928] |
| 7G6-HCzu11 | GGCTACACCTTCA CCACCTACTGG [SEQ ID NO: 929] | GYTFTTY W [SEQ ID NO: 930] | ATCTACCCCGGCTCCTCCATC TGC [SEQ ID NO: 931] | IYPGSS IC [SEQ ID NO: 932] | GCCAAAGAGGACGGCTACGACGCTT GGTTTGCCTAC [SEQ ID NO: 933] | AKEDGYDAWFAY [SEQ ID NO: 934] |

TABLE 1-continued

| | | | | |
|---|---|---|---|---|
| 7G6-HCzu12 | GGCTACACCTTCACCACCTACTGG [SEQ ID NO: 935] | GYTFTTYW [SEQ ID NO: 936] | ATCTACCCCGGCTCCTCCATCTGC [SEQ ID NO: 937] | IYPGSSIC [SEQ ID NO: 938] | GCCAGAGAGGACGGCTACGACGCTTGGTTTGCTTAC [SEQ ID NO: 939] | AREDGYDAWFAY [SEQ ID NO: 940] |
| 7G6-HCzu13 | GGCTACACCTTCACCACCTACTGG [SEQ ID NO: 941] | GYTFTTYW [SEQ ID NO: 942] | ATCTACCCCGGCTCCTCCATCTGC [SEQ ID NO: 943] | IYPGSSIC [SEQ ID NO: 944] | GCCAGAGAGGACGGCTACGACGCTTGGTTTGCTTAC [SEQ ID NO: 945] | AREDGYDAWFAY [SEQ ID NO: 946] |
| 7G6-HCzu14 | GGCTACACCTTCACCACCTACTGG [SEQ ID NO: 947] | GYTFTTYW [SEQ ID NO: 948] | ATCTACCCCGGCTCCTCCATCTGC [SEQ ID NO: 949] | IYPGSSIC [SEQ ID NO: 950] | GCCAGAGAGGACGGCTACGACGCTTGGTTTGCTTAC [SEQ ID NO: 951] | AREDGYDAWFAY [SEQ ID NO: 952] |
| 7G6-HCzu15 | GGCTACACCTTCACCACCTACTGG [SEQ ID NO: 953] | GYTFTTYW [SEQ ID NO: 954] | ATCTACCCCGGCTCCTCCATCTGC [SEQ ID NO: 955] | IYPGSSIC [SEQ ID NO: 956] | GCCAGAGAGGACGGCTACGACGCTTGGTTTGCTTAC [SEQ ID NO: 957] | AREDGYDAWFAY [SEQ ID NO: 958] |
| 7G6-HCzu16 | GGCTACACCTTCACCACCTACTGG [SEQ ID NO: 959] | GYTFTTYW [SEQ ID NO: 960] | ATCTACCCCGGCTCCTCCATCTGC [SEQ ID NO: 961] | IYPGSSIC [SEQ ID NO: 962] | GCCAGAGAGGACGGCTACGACGCTTGGTTTGCTTAC [SEQ ID NO: 963] | AREDGYDAWFAY [SEQ ID NO: 964] |
| 7G6-HCzu17 | GGCTACACCTTCACCACCTACTGG [SEQ ID NO: 965] | GYTFTTYW [SEQ ID NO: 966] | ATCTACCCCGGCTCCTCCATCTGC [SEQ ID NO: 967] | IYPGSSIC [SEQ ID NO: 968] | GCCAGAGAGGACGGCTACGACGCTTGGTTTGCTTAC [SEQ ID NO: 969] | AREDGYDAWFAY [SEQ ID NO: 970] |
| 7G6-HCzu18 | GGCTACACCTTCACCACCTACTGG [SEQ ID NO: 971] | GYTFTTYW [SEQ ID NO: 972] | ATCTACCCCGGCTCCTCCATCTGC [SEQ ID NO: 973] | IYPGSSIC [SEQ ID NO: 974] | GCCAGAGAGGACGGCTACGACGCTTGGTTTGCTTAC [SEQ ID NO: 975] | AREDGYDAWFAY [SEQ ID NO: 976] |
| 7G6-HCzu19 | GGCTACACCTTCACCACCTACTGG [SEQ ID NO: 977] | GYTFTTYW [SEQ ID NO: 978] | ATCTACCCCGGCTCCTCCATCTGC [SEQ ID NO: 979] | IYPGSSIC [SEQ ID NO: 980] | GCCAGAGAGGACGGCTACGACGCTTGGTTTGCTTAC [SEQ ID NO: 981] | AREDGYDAWFAY [SEQ ID NO: 982] |
| 7G6-HCzu20 | GGCTACACCTTCACCACCTACTGG [SEQ ID NO: 983] | GYTFTTYW [SEQ ID NO: 984] | ATCTACCCCGGCTCCTCCATCTGC [SEQ ID NO: 985] | IYPGSSIC [SEQ ID NO: 986] | GCCAAAGAGGACGGCTACGACGCTTGGTTTGCTTAC [SEQ ID NO: 987] | AKEDGYDAWFAY [SEQ ID NO: 988] |

TABLE 1-continued

| | VL CDR1 DNA Sequence | VL CDR1 Amino Acid Sequence | | | |
|---|---|---|---|---|---|
| 7G6-HCzu23 | GGCTACACCTTCA CCACCTACTGG [SEQ ID NO: 989] | GYTFTTY W [SEQ ID NO: 990] | ATCTACCCCGGCTCTCCCATC TCC [SEQ ID NO: 991] | IYPGSS IS [SEQ ID NO: 992] | GCTAGAGAGGACGGCTACGACGCTT GGTTTGCCTAC [SEQ ID NO: 993] | AREDGYDAWFAY [SEQ ID NO: 994] |
| 7G6-HCzu24 | GGCTACACCTTCA CCACCTACTGG [SEQ ID NO: 995] | GYTFTTY W [SEQ ID NO: 996] | ATCTACCCCGGCTCTCCCATC TCC [SEQ ID NO: 997] | IYPGSS IS [SEQ ID NO: 998] | GCCAGAGAGGACGGCTACGACGCTT GGTTTGCCTAC [SEQ ID NO: 999] | AREDGYDAWFAY [SEQ ID NO: 1000] |
| 7G6-HCzu25 | GGCTACACCTTCA CCACCTACTGG [SEQ ID NO: 1001] | GYTFTTY W [SEQ ID NO: 1002] | ATCTACCCCGGCTCTCCCATC TCC [SEQ ID NO: 1003] | IYPGSS IS [SEQ ID NO: 1004] | GCCAGAGAGGACGGCTACGACGCTT GGTTTGCCTAC [SEQ ID NO: 1005] | AREDGYDAWFAY [SEQ ID NO: 1006] |

7G6 VL numbered according to IMGT

| Clone Name (Species & Isotype) | VL CDR1 DNA Sequence | VL CDR1 Amino Acid Sequence | VL CDR2 DNA Sequence | VL CDR2 Amino Acid Sequence | VL CDR3 DNA Sequence | VL CDR3 Amino Acid Sequence |
|---|---|---|---|---|---|---|
| mouse 7G6-Vk | CAGAGCATTTTACATAGTAATGGAAACAC CTAT [SEQ ID NO: 1007] | QSILHSNGN TY [SEQ ID NO: 1008] | AAAGTTTC C [SEQ ID NO: 1009] | KVS [SEQ ID NO: 1010] | TTTCAAGGTTCACATGTTCCATTC ACG [SEQ ID NO: 1011] | FQGSHVPF T [SEQ ID NO: 1012] |
| 7G6-LCzu1 | CAGTCCCATCCTGCACTCCAACGGCAAACAC CTAC [SEQ ID NO: 1013] | QSILHSNGN TY [SEQ ID NO: 1014] | AAGGTGTC C [SEQ ID NO: 1015] | KVS [SEQ ID NO: 1016] | TTTCAAGGCTCCCACGTGCCCTTC ACC [SEQ ID NO: 1017] | FQGSHVPF T [SEQ ID NO: 1018] |
| 7G6-LCzu2 | CAGTCCCATCCTGCACTCCAACGGCAAACAC CTAC [SEQ ID NO: 1019] | QSILHSNGN TY [SEQ ID NO: 1020] | AAGGTGTC C [SEQ ID NO: 1021] | KVS [SEQ ID NO: 1022] | TTTCAAGGCTCCCACGTGCCCTTC ACC [SEQ ID NO: 1023] | FQGSHVPF T [SEQ ID NO: 1024] |
| 7G6-LCzu3 | CAGTCCCATCCTGCACTCCAACGGCAAACAC CTAC [SEQ ID NO: 1025] | QSILHSNGN TY [SEQ ID NO: 1026] | AAGGTGTC C [SEQ ID NO: 1027] | KVS [SEQ ID NO: 1028] | TTTCAAGGCTCCCACGTGCCCTTC ACC [SEQ ID NO: 1029] | FQGSHVPF T [SEQ ID NO: 1030] |
| 7G6-LCzu4 | CAGTCCCATCCTGCACTCCAACGGCAAACAC CTAC | QSILHSNGN TY | AAGGTGTC C | KVS | TTTCAAGGCTCCCACGTGCCCTTC ACC | FQGSHVPF T |

TABLE 1-continued

| | | | | | |
|---|---|---|---|---|---|
| | [SEQ ID NO: 1031] | [SEQ ID NO: 1032] | [SEQ ID NO: 1033] | [SEQ ID NO: 1034] | [SEQ ID NO: 1035] | [SEQ ID NO: 1036] |
| 7G6-LCzu5 | CAGTCCATCCTGCACTCCAACGGCAACAC CTAC [SEQ ID NO: 1037] | QSILHSNGN TY [SEQ ID NO: 1038] | AAGGTGTC C [SEQ ID NO: 1039] | KVS [SEQ ID NO: 1040] | TTTCAAGGCTCCCACGTGCCCTTC ACC [SEQ ID NO: 1041] | FQGSHVPF T [SEQ ID NO: 1042] |
| 7G6-LCzu6 | CAGTCCATCCTGCACTCCAACGGCAACAC CTAC [SEQ ID NO: 1043] | QSILHSNGN TY [SEQ ID NO: 1044] | AAGGTGTC C [SEQ ID NO: 1045] | KVS [SEQ ID NO: 1046] | TTTCAAGGCTCCCACGTGCCCTTC ACC [SEQ ID NO: 1047] | FQGSHVPF T [SEQ ID NO: 1048] |
| 7G6-LCzu7 | CAGTCCATCCTGCACTCCAACGGCAACAC CTAC [SEQ ID NO: 1049] | QSILHSNGN TY [SEQ ID NO: 1050] | AAGGTGTC C [SEQ ID NO: 1051] | KVS [SEQ ID NO: 1052] | TTTCAAGGCTCCCACGTGCCCTTC ACC [SEQ ID NO: 1053] | FQGSHVPF T [SEQ ID NO: 1054] |
| 7G6-LCzu8 | CAGTCCATCCTGTGCACTCCAACGGCAACAC CTAC [SEQ ID NO: 1055] | QSIVHSNGN TY [SEQ ID NO: 1056] | AAGGTGTC C [SEQ ID NO: 1057] | KVS [SEQ ID NO: 1058] | TTTCAAGGCTCCCACGTGCCCTTC ACC [SEQ ID NO: 1059] | FQGSHVPF T [SEQ ID NO: 1060] |
| 7G6-LCzu9 | CAGTCCATCGTGTGCACTCCAACGGCAACAC CTAC [SEQ ID NO: 1061] | QSIVHSNGN TY [SEQ ID NO: 1062] | AAGGTGTC C [SEQ ID NO: 1063] | KVS [SEQ ID NO: 1064] | TTTCAAGGCTCCCACGTGCCCTTC ACC [SEQ ID NO: 1065] | FQGSHVPF T [SEQ ID NO: 1066] |
| 7G6-LCzu10 | CAGTCCATCGTGCACTCCAACGGCAACAC CTAC [SEQ ID NO: 1067] | QSIVHSNGN TY [SEQ ID NO: 1068] | AAGGTGTC C [SEQ ID NO: 1069] | KVS [SEQ ID NO: 1070] | TTTCAAGGCTCCCACGTGCCCTTC ACC [SEQ ID NO: 1071] | FQGSHVPF T [SEQ ID NO: 1072] |
| 7G6-LCzu11 | CAGTCCATCCTGTGCACTCCAACGGCAACAC CTAC [SEQ ID NO: 1073] | QSILHSNGN TY [SEQ ID NO: 1074] | AAGGTGTC C [SEQ ID NO: 1075] | KVS [SEQ ID NO: 1076] | TTTCAAGGCTCCCACGTGCCCTTC ACC [SEQ ID NO: 1077] | FQGSHVPF T [SEQ ID NO: 1078] |
| 7G6-LCzu12 | CAGTCCATCCTGCACTCCAACGGCAACAC CTAC [SEQ ID NO: 1079] | QSILHSNGN TY [SEQ ID NO: 1080] | AAGGTGTC C [SEQ ID NO: 1081] | KVS [SEQ ID NO: 1082] | TTTCAAGGCTCCCACGTGCCCTTC ACC [SEQ ID NO: 1083] | FQGSHVPF T [SEQ ID NO: 1084] |

TABLE 1-continued

| | | | | | |
|---|---|---|---|---|---|
| 7G6-LCzu13 | CAGTCCATCCTGACTCCAACGGCAACAC CTAC [SEQ ID NO: 1085] | QSILHSNGN TY [SEQ ID NO: 1086] | AAGGTGTC C [SEQ ID NO: 1087] | KVS [SEQ ID NO: 1088] | TTTCAAGGCTCCCACGTGCCCTTC ACC [SEQ ID NO: 1089] | FQGSHVPF T [SEQ ID NO: 1090] |
| 7G6-LCzu14 | CAGTCCATCCTGACTCCAACGGCAACAC CTAC [SEQ ID NO: 1091] | QSILHSNGN TY [SEQ ID NO: 1092] | AAGGTGTC C [SEQ ID NO: 1093] | KVS [SEQ ID NO: 1094] | TTTCAAGGCTCCCACGTGCCCTTC ACC [SEQ ID NO: 1095] | FQGSHVPF T [SEQ ID NO: 1096] |
| 7G6-LCzu15 | CAGTCCATCCTGACTCCAACGGCAACAC CTAC [SEQ ID NO: 1097] | QSILHSNGN TY [SEQ ID NO: 1098] | AAGGTGTC C [SEQ ID NO: 1099] | KVS [SEQ ID NO: 1100] | TTTCAAGGCTCCCACGTGCCCTTC ACC [SEQ ID NO: 1101] | FQGSHVPF T [SEQ ID NO: 1102] |
| 7G6-LCzu16 | CAGTCCATCGTGACTCCAACGGCAACAC CTAC [SEQ ID NO: 1103] | QSIVHSNGN TY [SEQ ID NO: 1104] | AAGGTGTC C [SEQ ID NO: 1105] | KVS [SEQ ID NO: 1106] | TTTCAAGGCTCCCACGTGCCCTTC ACC [SEQ ID NO: 1107] | FQGSHVPF T [SEQ ID NO: 1108] |
| 7G6-LCzu17 | CAGTCCATCGTGACTCCAACGGCAACAC CTAC [SEQ ID NO: 1109] | QSIVHSNGN TY [SEQ ID NO: 1110] | AAGGTGTC C [SEQ ID NO: 1111] | KVS [SEQ ID NO: 1112] | TTTCAAGGCTCCCACGTGCCCTTC ACC [SEQ ID NO: 1113] | FQGSHVPF T [SEQ ID NO: 1114] |
| 7G6-LCzu18 | CAGTCCATCCTGACTCCAACGGCAACAC CTAC [SEQ ID NO: 1115] | QSILHSNGN TY [SEQ ID NO: 1116] | AAGGTGTC C [SEQ ID NO: 1117] | KVS [SEQ ID NO: 1118] | TTTCAAGGCTCCCACGTGCCCTTC ACC [SEQ ID NO: 1119] | FQGSHVPF T [SEQ ID NO: 1120] |
| 7G6-LCzu21 | CAGTCCATCCTGACTCCAACGGCAACAC CTAC [SEQ ID NO: 1121] | QSILHSNGN TY [SEQ ID NO: 1122] | AAGGTGTC C [SEQ ID NO: 1123] | KVS [SEQ ID NO: 1124] | TTTCAAGGCTCCCACGTGCCCTTC ACC [SEQ ID NO: 1125] | FQGSHVPF T [SEQ ID NO: 1126] |
| 7G6-LCzu22 | CAGTCCATCCTGACTCCAACGGCAACAC CTAC [SEQ ID NO: 1127] | QSILHSNGN TY [SEQ ID NO: 1128] | AAGGTGTC C [SEQ ID NO: 1129] | KVS [SEQ ID NO: 1130] | TTTCAAGGCTCCCACGTGCCCTTC ACC [SEQ ID NO: 1131] | FQGSHVPF T [SEQ ID NO: 1132] |

In some embodiments, the anti-Tau antibodies, or antigen-binding fragments thereof, include a heavy chain complementarity determining region 1 (HCDR1), a heavy chain complementarity determining region 2 (HCDR2), and a heavy chain complementarity determining region 3 (HCDR3) as set forth in SEQ ID NO: 196 and a light chain complementarity determining region 1 (LCDR1), a light chain complementarity determining region 2 (LCDR2), and a light chain complementarity determining region 3 (LCDR3) as set forth in SEQ ID NO: 411. In some embodiments, the anti-Tau antibodies, or antigen-binding fragments thereof, include a HCDR1, a HCDR2, and a HCDR3 as set forth in SEQ ID NO: 268 and a LCDR1, a LCDR2, and a LCDR3 as set forth in SEQ ID NO: 465. In some embodiments, the anti-Tau antibodies, or antigen-binding fragments thereof, include a HCDR1, a HCDR2, and a HCDR3 as set forth in SEQ ID NO: 402 and a LCDR1, a LCDR2, and a LCDR3 as set forth in SEQ ID NO: 572.

In some embodiments, the anti-Tau antibodies or antigen-binding fragments may include a light chain CDR1 amino acid sequence substantially the same as, or identical to, SEQ ID NO: 738, as defined according to the method of Kabat. In some embodiments, antibodies or antigen-binding fragments may include a light chain CDR2 amino acid sequence substantially the same as, or identical to, SEQ ID NO: 740, as defined according to the method of Kabat. In some embodiments, antibodies or antigen-binding fragments may include a light chain CDR3 amino acid sequence substantially the same as, or identical to, SEQ ID NO: 742, as defined according to the method of Kabat. In some embodiments, antibodies or antigen-binding fragments may include a heavy chain CDR1 amino acid sequence substantially the same as, or identical to, SEQ ID NO: 594, as defined according to the method of Kabat. In some embodiments, antibodies or antigen-binding fragments may include a heavy chain CDR2 amino acid sequence substantially the same as, or identical to, SEQ ID NO: 596, as defined according to the method of Kabat. In some embodiments, antibodies or antigen-binding fragments may include a heavy chain CDR3 amino acid sequence substantially the same as, or identical to, SEQ ID NO: 598, as defined according to the method of Kabat. The antibodies or antigen-binding fragments may include a light chain having a CDR1 amino acid sequence substantially the same as, or identical to, SEQ ID NO: 738, as defined according to the method of Kabat; a CDR2 amino acid sequence substantially the same as, or identical to, SEQ ID NO: 740, as defined according to the method of Kabat; and a CDR3 amino acid sequence substantially the same as, or identical to, SEQ ID NO: 742, as defined according to the method of Kabat. The antibodies or antigen-binding fragments may include a heavy chain having a CDR1 amino acid sequence substantially the same as, or identical to, SEQ ID NO: 594, as defined according to the method of Kabat; a CDR2 amino acid sequence substantially the same as, or identical to, SEQ ID NO: 596, as defined according to the method of Kabat; and a CDR3 amino acid sequence substantially the same as, or identical to, SEQ ID NO: 598, as defined according to the method of Kabat. The antibodies or antigen-binding fragments may include a light chain having a CDR1 amino acid sequence substantially the same as, or identical to, SEQ ID NO: 738, as defined according to the method of Kabat; a CDR2 amino acid sequence substantially the same as, or identical to, SEQ ID NO: 740, as defined according to the method of Kabat; and a CDR3 amino acid sequence substantially the same as, or identical to, SEQ ID NO: 742, as defined according to the method of Kabat, and also have a heavy chain having a CDR1 amino acid sequence substantially the same as, or identical to, SEQ ID NO: 594, as defined according to the method of Kabat; a CDR2 amino acid sequence substantially the same as, or identical to, SEQ ID NO: 596, as defined according to the method of Kabat; and a CDR3 amino acid sequence substantially the same as, or identical to, SEQ ID NO: 598, as defined according to the method of Kabat.

In some embodiments, the anti-Tau antibodies or antigen-binding fragments may include a light chain CDR1 amino acid sequence substantially the same as, or identical to, SEQ ID NO: 1008, as defined by IMGT. In some embodiments, antibodies or antigen-binding fragments may include a light chain CDR2 amino acid sequence substantially the same as, or identical to, SEQ ID NO: 1010, as defined by IMGT. In some embodiments, antibodies or antigen-binding fragments may include a light chain CDR3 amino acid sequence substantially the same as, or identical to, SEQ ID NO: 1012, as defined by IMGT. In some embodiments, antibodies or antigen-binding fragments may include a heavy chain CDR1 amino acid sequence substantially the same as, or identical to, SEQ ID NO: 864, as defined by IMGT. In some embodiments, antibodies or antigen-binding fragments may include a heavy chain CDR2 amino acid sequence substantially the same as, or identical to, SEQ ID NO: 866, as defined by IMGT. In some embodiments, antibodies or antigen-binding fragments may include a heavy chain CDR3 amino acid sequence substantially the same as, or identical to, SEQ ID NO: 868, as defined by IMGT. The antibodies or antigen-binding fragments may include a light chain having a CDR1 amino acid sequence substantially the same as, or identical to, SEQ ID NO: 1008, as defined by IMGT; a CDR2 amino acid sequence substantially the same as, or identical to, SEQ ID NO: 1010, as defined by IMGT; and a CDR3 amino acid sequence substantially the same as, or identical to, SEQ ID NO: 1012, as defined by IMGT. The antibodies or antigen-binding fragments may include a heavy chain having a CDR1 amino acid sequence substantially the same as, or identical to, SEQ ID NO: 864, as defined by IMGT; a CDR2 amino acid sequence substantially the same as, or identical to, SEQ ID NO: 866, as defined by IMGT; and a CDR3 amino acid sequence substantially the same as, or identical to, SEQ ID NO: 868, as defined by IMGT. The antibodies or antigen-binding fragments may include a light chain having a CDR1 amino acid sequence substantially the same as, or identical to, SEQ ID NO: 1008, as defined by IMGT; a CDR2 amino acid sequence substantially the same as, or identical to, SEQ ID NO: 1010, as defined by IMGT; and a CDR3 amino acid sequence substantially the same as, or identical to, SEQ ID NO: 1012, as defined by IMGT, and also have a heavy chain having a CDR1 amino acid sequence substantially the same as, or identical to, SEQ ID NO: 864, as defined by IMGT; a CDR2 amino acid sequence substantially the same as, or identical to, SEQ ID NO: 866, as defined by IMGT; and a CDR3 amino acid sequence substantially the same as, or identical to, SEQ ID NO: 868, as defined by IMGT.

In some embodiments, the anti-Tau antibodies or antigen-binding fragments may include a light chain CDR1 amino acid sequence substantially the same as, or identical to, SEQ ID NO: 774, as defined according to the method of Kabat. In some embodiments, antibodies or antigen-binding fragments may include a light chain CDR2 amino acid sequence substantially the same as, or identical to, SEQ ID NO: 776, as defined according to the method of Kabat. In some embodiments, antibodies or antigen-binding fragments may include a light chain CDR3 amino acid sequence substantially the same as, or identical to, SEQ ID NO: 778, as defined according to the method of Kabat. In some embodiments, antibodies or antigen-binding fragments may include a heavy chain CDR1 amino acid sequence substantially the same as, or identical to, SEQ ID NO: 642, as defined according to the method of Kabat. In some embodiments, antibodies or antigen-binding fragments may include a heavy chain CDR2 amino acid sequence substantially the same as, or identical to, SEQ ID NO: 644, as defined according to the method of Kabat. In some embodiments, antibodies or antigen-binding fragments may include a heavy chain CDR3 amino acid sequence substantially the same as, or identical to, SEQ ID NO: 646, as defined according to the method of Kabat. The antibodies or antigen-binding fragments may include a light chain having a CDR1 amino acid sequence substantially the same as, or identical to, SEQ ID NO: 774, as defined according to the method of Kabat; a CDR2 amino acid sequence substantially the same as, or identical to, SEQ ID NO: 776, as defined according to the method of Kabat; and a CDR3 amino acid sequence substantially the same as, or identical to, SEQ ID NO: 778, as defined according to the method of Kabat. The antibodies or antigen-binding fragments may include a heavy chain having a CDR1 amino acid sequence substantially the same as, or identical to, SEQ ID NO: 642, as defined according to the method of Kabat; a CDR2 amino acid sequence substantially the same as, or identical to, SEQ ID NO: 644, as defined according to the method of Kabat; and a CDR3 amino acid sequence substantially the same as, or identical to, SEQ ID NO: 646, as defined according to the method of Kabat. The antibodies or antigen-binding fragments may include a light chain having a CDR1 amino acid sequence substantially the same as, or identical to, SEQ ID NO: 774, as defined according to the method of Kabat; a CDR2 amino acid sequence substantially the same as, or identical to, SEQ ID NO: 776, as defined according to the method of Kabat; and a CDR3 amino acid sequence substantially the same as, or identical to, SEQ ID NO: 778, as defined according to the method of Kabat, and also have a heavy chain having a CDR1 amino acid sequence substantially the same as, or identical to, SEQ ID NO: 642, as defined according to the method of Kabat; a CDR2 amino acid sequence substantially the same as, or identical to, SEQ ID NO: 644, as defined according to the method of Kabat; and a CDR3 amino acid sequence substantially the same as, or identical to, SEQ ID NO: 646, as defined according to the method of Kabat.

In some embodiments, the anti-Tau antibodies or antigen-binding fragments may include a light chain CDR1 amino acid sequence substantially the same as, or identical to, SEQ ID NO: 1044, as defined according to the method of IMGT. In some embodiments, antibodies or antigen-binding fragments may include a light chain CDR2 amino acid sequence substantially the same as, or identical to, SEQ ID NO: 1046, as defined according to the method of IMGT. In some embodiments, antibodies or antigen-binding fragments may include a light chain CDR3 amino acid sequence substantially the same as, or identical to, SEQ ID NO: 1048, as defined according to the method of IMGT. In some embodiments, antibodies or antigen-binding fragments may include a heavy chain CDR1 amino acid sequence substantially the same as, or identical to, SEQ ID NO: 912, as defined according to the method of IMGT. In some embodiments, antibodies or antigen-binding fragments may include a heavy chain CDR2 amino acid sequence substantially the same as, or identical to, SEQ ID NO: 914, as defined according to the method of IMGT. In some embodiments, antibodies or antigen-binding fragments may include a heavy chain CDR3 amino acid sequence substantially the same as, or identical to, SEQ ID NO: 916, as defined according to the method of IMGT. The antibodies or antigen-binding fragments may include a light chain having a CDR1 amino acid sequence substantially the same as, or identical to, SEQ ID NO: 1044, as defined according to the method of IMGT; a CDR2 amino acid sequence substantially the same as, or identical to, SEQ ID NO: 1046, as defined according to the method of IMGT; and a CDR3 amino acid sequence substantially the same as, or identical to, SEQ ID NO: 1048, as defined according to the method of IMGT. The antibodies or antigen-binding fragments may include a heavy chain having a CDR1 amino acid sequence substantially the same as, or identical to, SEQ ID NO: 912, as defined according to the method of IMGT; a CDR2 amino acid sequence substantially the same as, or identical to, SEQ ID NO: 914, as defined according to the method of IMGT; and a CDR3 amino acid sequence substantially the same as, or identical to, SEQ ID NO: 916, as defined according to the method of IMGT. The antibodies or antigen-binding fragments may include a light chain having a CDR1 amino acid sequence substantially the same as, or identical to, SEQ ID NO: 1044, as defined according to the method of IMGT; a CDR2 amino acid sequence substantially the same as, or identical to, SEQ ID NO: 1046, as defined according to the method of IMGT; and a CDR3 amino acid sequence substantially the same as, or identical to, SEQ ID NO: 1048, as defined according to the method of IMGT, and also have a heavy chain having a CDR1 amino acid sequence substantially the same as, or identical to, SEQ ID NO: 912, as defined according to the method of IMGT; a CDR2 amino acid sequence substantially the same as, or identical to, SEQ ID NO: 914, as defined according to the method of IMGT; and a CDR3 amino acid sequence substantially the same as, or identical to, SEQ ID NO: 916, as defined according to the method of IMGT.

In some embodiments, the anti-Tau antibodies or antigen-binding fragments may include a light chain CDR1 amino acid sequence substantially the same as, or identical to, SEQ ID NO: 846, as defined according to the method of Kabat. In some embodiments, antibodies or antigen-binding fragments may include a light chain CDR2 amino acid sequence substantially the same as, or identical to, SEQ ID NO: 848, as defined according to the method of Kabat. In some embodiments, antibodies or antigen-binding fragments may include a light chain CDR3 amino acid sequence substantially the same as, or identical to, SEQ ID NO: 850, as defined according to the method of Kabat. In some embodiments, antibodies or antigen-binding fragments may include a heavy chain CDR1 amino acid sequence substantially the same as, or identical to, SEQ ID NO: 732, as defined according to the method of Kabat. In some embodiments, antibodies or antigen-binding fragments may include a heavy chain CDR2 amino acid sequence substantially the same as, or identical to, SEQ ID NO: 734, as defined according to the method of Kabat. In some embodiments, antibodies or antigen-binding fragments may include a heavy chain CDR3 amino acid sequence substantially the same as, or identical to, SEQ ID NO: 736, as defined according to the method of Kabat. The antibodies or antigen-binding fragments may include a light chain having a CDR1 amino acid sequence substantially the same as, or identical to, SEQ ID NO: 846, as defined according to the method of Kabat; a CDR2 amino acid sequence substantially the same as, or identical to, SEQ ID NO: 848, as defined according to the method of Kabat; and a CDR3 amino acid sequence substantially the same as, or identical to, SEQ ID NO: 850, as defined according to the method of Kabat. The antibodies or antigen-binding fragments may include a heavy chain having a CDR1 amino acid sequence substantially the same as, or identical to, SEQ ID NO: 732, as defined according to the method of Kabat; a CDR2 amino acid sequence substantially the same as, or identical to, SEQ ID NO: 734, as defined according to the method of Kabat; and a CDR3 amino acid sequence substantially the same as, or identical to, SEQ ID NO: 736, as defined according to the method of Kabat. The antibodies or antigen-binding fragments may include a light chain having a CDR1 amino acid sequence substantially the same as, or identical to, SEQ ID NO: 846, as defined according to the method of Kabat; a CDR2 amino acid sequence substantially the same as, or identical to, SEQ ID NO: 848, as defined according to the method of Kabat; and a CDR3 amino acid sequence substantially the same as, or identical to, SEQ ID NO: 850, as defined according to the method of Kabat, and also have a heavy chain having a CDR1 amino acid sequence substantially the same as, or identical to, SEQ ID NO: 732, as defined according to the method of Kabat; a CDR2 amino acid sequence substantially the same as, or identical to, SEQ ID NO: 734, as defined according to the method of Kabat; and a CDR3 amino acid sequence substantially the same as, or identical to, SEQ ID NO: 736, as defined according to the method of Kabat.

In some embodiments, the anti-Tau antibodies or antigen-binding fragments may include a light chain CDR1 amino acid sequence substantially the same as, or identical to, SEQ ID NO: 1116, as defined by IMGT. In some embodiments, antibodies or antigen-binding fragments may include a light chain CDR2 amino acid sequence substantially the same as, or identical to, SEQ ID NO: 1118, as defined by IMGT. In some embodiments, antibodies or antigen-binding fragments may include a light chain CDR3 amino acid sequence substantially the same as, or identical to, SEQ ID NO: 1120, as defined by IMGT. In some embodiments, antibodies or antigen-binding fragments may include a heavy chain CDR1 amino acid sequence substantially the same as, or identical to, SEQ ID NO: 1002, as defined by IMGT. In some embodiments, antibodies or antigen-binding fragments may include a heavy chain CDR2 amino acid sequence substantially the same as, or identical to, SEQ ID NO: 1004, as defined by IMGT. In some embodiments, antibodies or antigen-binding fragments may include a heavy chain CDR3 amino acid sequence substantially the same as, or identical to, SEQ ID NO: 1006, as defined by IMGT. The antibodies or antigen-binding fragments may include a light chain having a CDR1 amino acid sequence substantially the same as, or identical to, SEQ ID NO: 1116, as defined by IMGT; a CDR2 amino acid sequence substantially the same as, or identical to, SEQ ID NO: 1118, as defined by IMGT; and a CDR3 amino acid sequence substantially the same as, or identical to, SEQ ID NO: 1120, as defined by IMGT. The antibodies or antigen-binding fragments may include a heavy chain having a CDR1 amino acid sequence substantially the same as, or identical to, SEQ ID NO: 1002, as defined by IMGT; a CDR2 amino acid sequence substantially the same as, or identical to, SEQ ID NO: 1004, as defined by IMGT; and a CDR3 amino acid sequence substantially the same as, or identical to, SEQ ID NO: 1006, as defined by IMGT. The antibodies or antigen-binding fragments may include a light chain having a CDR1 amino acid sequence substantially the same as, or identical to, SEQ ID NO: 1116, as defined by IMGT; a CDR2 amino acid sequence substantially the same as, or identical to, SEQ ID NO: 1118, as defined by IMGT; and a CDR3 amino acid sequence substantially the same as, or identical to, SEQ ID NO: 1120, as defined by IMGT, and also have a heavy chain having a CDR1 amino acid sequence substantially the same as, or identical to, SEQ ID NO: 1002, as defined by IMGT; a CDR2 amino acid sequence substantially the same as, or identical to, SEQ ID NO: 1004, as defined by IMGT; and a CDR3 amino acid sequence substantially the same as, or identical to, SEQ ID NO: 1006, as defined by IMGT.

Antigen-binding arrangements of CDRs may also be engineered using antibody-like proteins as CDR scaffolding. Such engineered antigen-binding proteins are within the scope of the disclosure.

In some embodiments of the antibodies or antigen-binding fragments that specifically bind Tau described herein, certain residues are altered to improve the binding and/or folding characteristics of the antibody or antigen-binding fragment. For example, in some embodiments of the disclosed monoclonal antibodies and antigen-binding fragments, the residue at position 49 of the light chain according to the method of Kabat is not cysteine. In some embodiments of the disclosed monoclonal antibodies and antigen-binding fragments, the residue at position 49 of the light chain according to the method of Kabat is serine. In some embodiments of the antibodies or antigen-binding fragments that specifically bind Tau described herein, the residue at position 57 of the heavy chain according to the method of Kabat is not cysteine. In some embodiments, the residue at position 57 of the heavy chain according to the method of Kabat is serine. In some embodiments of the antibodies or antigen-binding fragments that specifically bind Tau described herein, the residue at position 34 of the light chain according to the method of Kabat is glutamate. In some embodiments of the antibodies or antigen-binding fragments that specifically bind Tau described herein, the residue at position 36 of the light chain according to the method of Kabat is not phenylalanine. The residue at position 36 of the light chain according to the method of Kabat may be tyrosine. In some embodiments of the antibodies or antigen-binding fragments that specifically bind Tau described herein, the residue at position 46 of the light chain according to the method of Kabat is not arginine. The residue at position 46 of the light chain according to the method of Kabat may be leucine. In some embodiments of the antibodies or antigen-binding fragments that specifically bind Tau described herein, the residue at position 94 of the heavy chain according to the method of Kabat is not lysine. In some embodiments of the antibodies or antigen-binding fragments that specifically bind Tau described herein, the residue at position 71 of the heavy chain according to the method of Kabat is not arginine. The residue at position 71 of the heavy chain according to the method of Kabat may be valine.

The described antibodies or antigen-binding fragments that specifically bind Tau may include a light chain variable domain that includes an amino acid sequence substantially the same as, or identical to, SEQ ID NO: 411. In some aspects, an isolated polynucleotide that encodes a sequence substantially the same as, or identical to, SEQ ID NO: 411 is provided. In some embodiments, an isolated polynucleotide that includes a sequence substantially the same as, or identical to, SEQ ID NO: 410 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 196. In some aspects, an isolated polynucleotide that encodes a sequence substantially the same as, or identical to, SEQ ID NO: 196 is provided. In some embodiments, an isolated polynucleotide that includes a sequence substantially the same as, or identical to, SEQ ID NO: 195 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 411, and the heavy chain variable domain includes an amino acid sequence substantially the same as, or identical to, SEQ ID NO: 196. In some aspects, an isolated polynucleotide that encodes a sequence substantially the same as, or identical to, SEQ ID NO: 411 and a sequence substantially the same as, or identical to, SEQ ID NO: 196 is provided. In some embodiments an isolated polynucleotide that includes a sequence substantially the same as, or identical to, SEQ ID NO: 410 and a sequence substantially the same as, or identical to, SEQ ID NO: 195 is provided.

The described antibodies or antigen-binding fragments that specifically bind Tau may include a light chain variable domain that includes an amino acid sequence substantially the same as, or identical to, SEQ ID NO: 465. In some aspects, an isolated polynucleotide that encodes a sequence substantially the same as, or identical to, SEQ ID NO: 465 is provided. In some embodiments, an isolated polynucleotide that includes a sequence substantially the same as, or identical to, SEQ ID NO: 464 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 268. In some aspects, an isolated polynucleotide that encodes a sequence substantially the same as, or identical to, SEQ ID NO: 268 is provided. In some embodiments, an isolated polynucleotide that includes a sequence substantially the same as, or identical to, SEQ ID NO: 267 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 465, and the heavy chain variable domain includes an amino acid sequence substantially the same as, or identical to, SEQ ID NO: 268. In some aspects, an isolated polynucleotide that encodes a sequence substantially the same as, or identical to, SEQ ID NO: 465 and a sequence substantially the same as, or identical to, SEQ ID NO: 268 is provided. In some embodiments an isolated polynucleotide that includes a sequence substantially the same as, or identical to, SEQ ID NO: 464 and a sequence substantially the same as, or identical to, SEQ ID NO: 267 is provided.

The described antibodies or antigen-binding fragments that specifically bind Tau may include a light chain variable domain that includes an amino acid sequence substantially the same as, or identical to, SEQ ID NO: 581. In some aspects, an isolated polynucleotide that encodes a sequence substantially the same as, or identical to, SEQ ID NO: 581 is provided. In some embodiments, an isolated polynucleotide that includes a sequence substantially the same as, or identical to, SEQ ID NO: 580 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 268. In some aspects, an isolated polynucleotide that encodes a sequence substantially the same as, or identical to, SEQ ID NO: 268 is provided. In some embodiments, an isolated polynucleotide that includes a sequence substantially the same as, or identical to, SEQ ID NO: 267 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 581, and the heavy chain variable domain includes an amino acid sequence substantially the same as, or identical to, SEQ ID NO: 268. In some aspects, an isolated polynucleotide that encodes a sequence substantially the same as, or identical to, SEQ ID NO: 581 and a sequence substantially the same as, or identical to, SEQ ID NO: 268 is provided. In some embodiments an isolated polynucleotide that includes a sequence substantially the same as, or identical to, SEQ ID NO: 580 and a sequence substantially the same as, or identical to, SEQ ID NO: 267 is provided.

The described antibodies or antigen-binding fragments that specifically bind Tau may include a light chain variable domain that includes an amino acid sequence substantially the same as, or identical to, SEQ ID NO: 545. In some aspects, an isolated polynucleotide that encodes a sequence substantially the same as, or identical to, SEQ ID NO: 545 is provided. In some embodiments, an isolated polynucleotide that includes a sequence substantially the same as, or identical to, SEQ ID NO: 544 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 384. In some aspects, an isolated polynucleotide that encodes a sequence substantially the same as, or identical to, SEQ ID NO: 384 is provided. In some embodiments, an isolated polynucleotide that includes a sequence substantially the same as, or identical to, SEQ ID NO: 383 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 545, and the heavy chain variable domain includes an amino acid sequence substantially the same as, or identical to, SEQ ID NO: 384. In some aspects, an isolated polynucleotide that encodes a sequence substantially the same as, or identical to, SEQ ID NO: 545 and a sequence substantially the same as, or identical to, SEQ ID NO: 384 is provided. In some embodiments an isolated polynucleotide that includes a sequence substantially the same as, or identical to, SEQ ID NO: 544 and a sequence substantially the same as, or identical to, SEQ ID NO: 383 is provided.

The described antibodies or antigen-binding fragments that specifically bind Tau may include a light chain variable domain that includes an amino acid sequence substantially the same as, or identical to, SEQ ID NO: 545. In some aspects, an isolated polynucleotide that encodes a sequence substantially the same as, or identical to, SEQ ID NO: 545 is provided. In some embodiments, an isolated polynucleotide that includes a sequence substantially the same as, or identical to, SEQ ID NO: 544 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 393. In some aspects, an isolated polynucleotide that encodes a sequence substantially the same as, or identical to, SEQ ID NO: 393 is provided. In some embodiments, an isolated polynucleotide that includes a sequence substantially the same as, or identical to, SEQ ID NO: 392 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 545, and the heavy chain variable domain includes an amino acid sequence substantially the same as, or identical to, SEQ ID NO: 393. In some aspects, an isolated polynucleotide that encodes a sequence substantially the same as, or identical to, SEQ ID NO: 545 and a sequence substantially the same as, or identical to, SEQ ID NO: 393 is provided. In some embodiments an isolated polynucleotide that includes a sequence substantially the same as, or identical to, SEQ ID NO: 544 and a sequence substantially the same as, or identical to, SEQ ID NO: 392 is provided.

The described antibodies or antigen-binding fragments that specifically bind Tau may include a light chain variable domain that includes an amino acid sequence substantially the same as, or identical to, SEQ ID NO: 545. In some aspects, an isolated polynucleotide that encodes a sequence substantially the same as, or identical to, SEQ ID NO: 545 is provided. In some embodiments, an isolated polynucleotide that includes a sequence substantially the same as, or identical to, SEQ ID NO: 544 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 402. In some aspects, an isolated polynucleotide that encodes a sequence substantially the same as, or identical to, SEQ ID NO: 402 is provided. In some embodiments, an isolated polynucleotide that includes a sequence substantially the same as, or identical to, SEQ ID NO: 401 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 545, and the heavy chain variable domain includes an amino acid sequence substantially the same as, or identical to, SEQ ID NO: 402. In some aspects, an isolated polynucleotide that encodes a sequence substantially the same as, or identical to, SEQ ID NO: 545 and a sequence substantially the same as, or identical to, SEQ ID NO: 402 is provided. In some embodiments an isolated polynucleotide that includes a sequence substantially the same as, or identical to, SEQ ID NO: 544 and a sequence substantially the same as, or identical to, SEQ ID NO: 401 is provided.

The described antibodies or antigen-binding fragments that specifically bind Tau may include a light chain variable domain that includes an amino acid sequence substantially the same as, or identical to, SEQ ID NO: 572. In some aspects, an isolated polynucleotide that encodes a sequence substantially the same as, or identical to, SEQ ID NO: 572 is provided. In some embodiments, an isolated polynucleotide that includes a sequence substantially the same as, or identical to, SEQ ID NO: 571 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 384. In some aspects, an isolated polynucleotide that encodes a sequence substantially the same as, or identical to, SEQ ID NO: 384 is provided. In some embodiments, an isolated polynucleotide that includes a sequence substantially the same as, or identical to, SEQ ID NO: 383 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 572, and the heavy chain variable domain includes an amino acid sequence substantially the same as, or identical to, SEQ ID NO: 384. In some aspects, an isolated polynucleotide that encodes a sequence substantially the same as, or identical to, SEQ ID NO: 572 and a sequence substantially the same as, or identical to, SEQ ID NO: 384 is provided. In some embodiments an isolated polynucleotide that includes a sequence substantially the same as, or identical to, SEQ ID NO: 571 and a sequence substantially the same as, or identical to, SEQ ID NO: 383 is provided.

The described antibodies or antigen-binding fragments that specifically bind Tau may include a light chain variable domain that includes an amino acid sequence substantially the same as, or identical to, SEQ ID NO: 572. In some aspects, an isolated polynucleotide that encodes a sequence substantially the same as, or identical to, SEQ ID NO: 572 is provided. In some embodiments, an isolated polynucleotide that includes a sequence substantially the same as, or identical to, SEQ ID NO: 571 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 393. In some aspects, an isolated polynucleotide that encodes a sequence substantially the same as, or identical to, SEQ ID NO: 393 is provided. In some embodiments, an isolated polynucleotide that includes a sequence substantially the same as, or identical to, SEQ ID NO: 392 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 572, and the heavy chain variable domain includes an amino acid sequence substantially the same as, or identical to, SEQ ID NO: 393. In some aspects, an isolated polynucleotide that encodes a sequence substantially the same as, or identical to, SEQ ID NO: 572 and a sequence substantially the same as, or identical to, SEQ ID NO: 393 is provided. In some embodiments an isolated polynucleotide that includes a sequence substantially the same as, or identical to, SEQ ID NO: 571 and a sequence substantially the same as, or identical to, SEQ ID NO: 392 is provided.

The described antibodies or antigen-binding fragments that specifically bind Tau may include a light chain variable domain that includes an amino acid sequence substantially the same as, or identical to, SEQ ID NO: 572. In some aspects, an isolated polynucleotide that encodes a sequence substantially the same as, or identical to, SEQ ID NO: 572 is provided. In some embodiments, an isolated polynucleotide that includes a sequence substantially the same as, or identical to, SEQ ID NO: 571 may encode this light chain variable domain amino acid sequence. The described antibodies or antigen-binding fragments that specifically bind Tau may include a heavy chain variable domain that includes an amino acid sequence substantially the same as, or identical to, SEQ ID NO: 402. In some aspects, an isolated polynucleotide that encodes a sequence substantially the same as, or identical to, SEQ ID NO: 402 is provided. In some embodiments, an isolated polynucleotide that includes a sequence substantially the same as, or identical to, SEQ ID NO: 401 may encode this heavy chain variable domain amino acid sequence. The described antibodies or antigen-binding fragments that specifically bind Tau may include a light chain variable domain and a heavy chain variable domain, wherein the light chain variable domain includes an amino acid sequence substantially the same as, or identical to, SEQ ID NO: 572, and the heavy chain variable domain includes an amino acid sequence substantially the same as, or identical to, SEQ ID NO: 402. In some aspects, an isolated polynucleotide that encodes a sequence substantially the same as, or identical to, SEQ ID NO: 572 and a sequence substantially the same as, or identical to, SEQ ID NO: 402 is provided. In some embodiments an isolated polynucleotide that includes a sequence substantially the same as, or identical to, SEQ ID NO: 571 and a sequence substantially the same as, or identical to, SEQ ID NO: 401 is provided.

In some embodiments, the antibodies that specifically bind Tau are produced by antibody-producing cells deposited with the American Type Culture Collection (10801 University Blvd., Manassas, Va. 20110-2209) on Oct. 11, 2017 and have been assigned Accession No. PTA-124523 or PTA-124524. In some embodiments, the antibodies, or antigen-binding fragments thereof, have the binding affinity for monomeric wild-type 2N4R Tau of the antibodies produced by the deposited antibody-producing cells as measured by surface plasmon resonance. In some embodiments, the disclosed antibodies, or antigen-binding fragments thereof, comprise the light and heavy chain CDRs of the antibodies produced by the deposited antibody-producing cells. In some embodiments, the antibodies, or antigen-binding fragments thereof, comprise the light and heavy chain variable regions of the antibodies produced by the deposited antibody-producing cells.

The antibodies or antigen-binding fragments that specifically bind Tau described herein include variants having single or multiple amino acid substitutions, deletions, or additions that retain the biological properties (e.g., binding affinity or immune effector activity) of the described antibodies or antigen-binding fragments. The skilled person may produce variants having single or multiple amino acid substitutions, deletions, or additions. These variants may include: (a) variants in which one or more amino acid residues are substituted with conservative or nonconservative amino acids, (b) variants in which one or more amino acids are added to or deleted from the polypeptide, (c) variants in which one or more amino acids include a substituent group, and (d) variants in which the polypeptide is fused with another peptide or polypeptide such as a fusion partner, a protein tag or other chemical moiety, that may confer useful properties to the polypeptide, such as, for example, an epitope for an antibody, a polyhistidine sequence, a biotin moiety and the like. Antibodies or antigen-binding fragments described herein may include variants in which amino acid residues from one species are substituted for the corresponding residue in another species, either at the conserved or nonconserved positions. In other embodiments, amino acid residues at nonconserved positions are substituted with conservative or nonconservative residues. The techniques for obtaining these variants, including genetic (suppressions, deletions, mutations, etc.), chemical, and enzymatic techniques, are known to the person having ordinary skill in the art.

The antibodies or antigen-binding fragments described herein have binding affinities (in nM) for wild-type monomeric 2N4R Tau that include a dissociation constant ($K_D$) of less than about $1 \times 10^{-8}$ M as measured by surface plasmon resonance. In certain embodiments, the antibodies or antigen-binding fragments described herein have binding affinities (in nM) for wild-type monomeric 2N4R Tau that include a dissociation constant ($K_D$) of less than about 0.5 nM as measured by surface plasmon resonance. In certain embodiments, the antibodies or antigen-binding fragments described herein have binding affinities (in nM) for wild-type monomeric 2N4R Tau that include a dissociation constant ($K_D$) of less than about 0.3 nM as measured by surface plasmon resonance. In certain embodiments, the antibodies or antigen-binding fragments described herein have binding affinities (in nM) for wild-type monomeric 2N4R Tau that include a dissociation constant ($K_D$) of less than about 0.2 nM as measured by surface plasmon resonance. In certain embodiments, the antibodies or antigen-binding fragments described herein have binding affinities (in nM) for wild-type monomeric 2N4R Tau that include a dissociation constant ($K_D$) of less than about 0.15 nM as measured by surface plasmon resonance. In certain embodiments, the antibodies or antigen-binding fragments described herein have binding affinities (in nM) for wild-type monomeric 2N4R Tau that include a dissociation constant ($K_D$) of less than about 0.1 nM as measured by surface plasmon resonance.

In any of the embodiments of the antibodies or antigen-binding fragments that specifically bind Tau described herein, the antibodies or antigen-binding fragments may bind an epitope comprising HVPG (SEQ ID NO: 1133). In some embodiments, the antibodies or antigen-binding fragments that specifically bind Tau described herein are biepitopic. In certain aspects, the antibodies or antigen-binding fragments that specifically bind Tau described herein bind one or more epitopes within Tau comprising HVPG (SEQ ID NO: 1133). This sequence appears twice in human 2N4R Tau. The first site is in 2N4R Tau within the second repeat region at residues 299-302 and the second site within the fourth repeat region at residues 362-365.

In any of the embodiments of the antibodies or antigen-binding fragments that specifically bind Tau described herein, the antibodies or antigen-binding fragments may bind an epitope comprising HVPGG (SEQ ID NO: 79). In some embodiments, the antibodies or antigen-binding fragments that specifically bind Tau described herein are biepitopic. In certain aspects, the antibodies or antigen-binding fragments that specifically bind Tau described herein bind one or more epitopes within Tau comprising HVPGG (SEQ ID NO: 79). This sequence appears twice in human 2N4R Tau. The first site is in 2N4R Tau within the second repeat region at residues 299-303 and the second site within the fourth repeat region at residues 362-366. In certain aspects, the antibodies or antigen-binding fragments that specifically bind Tau bind the epitope within Tau comprising HVPGG (SEQ ID NO: 79) within repeat region 2 or repeat region 4 with a peptide binding preference that is at least 10-fold, preferably at least 20-fold, and more preferably at least 30-fold greater than binding to an epitope within Tau comprising HKPGG (SEQ ID NO: 182) within repeat region 3 as determined by a peptide binding assay (e.g., the peptide binding assay described in Example 3). In certain aspects, the antibodies or antigen-binding fragments that specifically bind Tau bind the epitope within Tau comprising HVPGG (SEQ ID NO: 79) within repeat region 2 or repeat region 4 with a peptide binding preference that is at least 10-fold, preferably at least 20-fold, and more preferably at least 30-fold greater than binding to an epitope within Tau comprising HQPGG (SEQ ID NO: 183) within repeat region 1, as determined by a peptide binding assay (e.g., the peptide binding assay described in Example 3). In certain aspects, the antibodies or antigen-binding fragments that specifically bind Tau bind the epitope within Tau comprising HVPGG (SEQ ID NO: 79) within repeat region 2 or repeat region 4 with a peptide binding preference that is at least 10-fold, preferably at least 20-fold, and more preferably at least 30-fold greater than binding to an epitope within Tau comprising HKPGG (SEQ ID NO: 182) within repeat region 3 and that is at least 10-fold, preferably at least 20-fold, and more preferably at least 30-fold greater than binding to an epitope comprising HQPGG (SEQ ID NO: 183) within repeat region 1, as determined by a peptide binding assay (e.g., the peptide binding assay described in Example 3). In certain aspects, the antibodies or antigen-binding fragments that specifically bind Tau do not bind an epitope within naturally occurring mutant P301S Tau comprising HVSGG (SEQ ID NO: 184) within repeat region 2 as determined by a peptide binding assay (e.g., the peptide binding assay described in Example 4). In certain aspects, the antibodies or antigen-binding fragments that specifically bind Tau do not bind an epitope within naturally occurring mutant P301L Tau comprising HVLGG (SEQ ID NO: 185) within repeat region 2 as determined by a peptide binding assay (e.g., the peptide binding assay described in Example 4). The amino acid sequence HVSGG (SEQ ID NO: 184) is present at residues 299-303 in the 2N4R Tau sequence of P301S in vitro and in vivo Tauopathy models. The amino acid sequence HVLGG (SEQ ID NO: 185) is present at residues 299-303 of the 2N4R Tau sequence of P301L in vitro and in vivo Tauopathy models. Antibodies or antigen-binding fragments as provided herein that preferably bind one or more epitopes within Tau comprising HVPGG (SEQ ID NO: 79) within repeat region 2 or repeat region 4 relative to an epitope comprising HKPGG (SEQ ID NO: 182 within repeat region 3 or HQPGG (SEQ ID NO: 183) within repeat region 1 and do not bind an epitope comprising HVSGG (SEQ ID NO: 184), or HVLGG (SEQ ID NO: 185) within repeat region 2 bind 2N4R Tau P301S/L at residues 362-366. Surprisingly, as demonstrated herein, the described antibodies or antigen-binding fragments that preferably bind one or more epitopes within Tau comprising HVPGG (SEQ ID NO: 79) within repeat region 2 or repeat region 4 relative to an epitope comprising HKPGG (SEQ ID NO: 182) within repeat region 3 or HQPGG (SEQ ID NO: 183) within repeat region 1 and that do not exhibit binding to an epitope comprising HVSGG (SEQ ID NO: 184) or HVLGG (SEQ ID NO: 185) within repeat region 2 reduce Tau seeding and transmission in vivo.

In certain embodiments, labelled anti-Tau antibodies are provided. Labels include, but are not limited to, labels or moieties that are detected directly (e.g., fluorescent, chromophoric, electron-dense, chemiluminescent, and radioactive labels) and labels and moieties (e.g., enzymes or ligands) that are detected indirectly (e.g., through enzymatic reaction or molecular interaction). Exemplary labels include but are not limited to radiolabels (e.g., $^{32}P$, $^{14}C$, $^{111}I$, $^{125}I$, $^{3}H$, $^{131}I$), fluorescent labels (such as DyLight™ 649), epitope tags, biotin, chromophore labels, ECL labels, or enzymes. More specifically, the described labels include ruthenium, $^{111}In$-DOTA, $^{111}In$-diethylenetriaminepentaacetic acid (DTPA), horseradish peroxidase, alkaline phosphatase and beta-galactosidase, poly-histidine (HIS tag), acridine dyes, cyanine dyes, fluorone dyes, oxazin dyes, phenanthridine dyes, rhodamine dyes, Alexafluor™ dyes, and the like.

Also disclosed are isolated polynucleotides that encode antibodies or antigen-binding fragments that specifically bind to Tau. In some embodiments, the isolated polynucleotides encode an antibody or antigen-binding fragment thereof having a light chain CDR1 sequence defined according to Kabat substantially the same as, or identical to, SEQ ID NO: 738, for example SEQ ID NO: 737. In some embodiments, the isolated polynucleotides encode an antibody or antigen-binding fragment thereof having a light chain CDR2 defined according to Kabat substantially the same as, or identical to, SEQ ID NO: 740, for example SEQ ID NO: 739. In some embodiments, the isolated polynucleotides encode an antibody or antigen-binding fragment thereof having a light chain CDR3 defined according to Kabat substantially the same as, or identical to, SEQ ID NO: 742, for example SEQ ID NO: 741. In some embodiments, the isolated polynucleotides encode an antibody or antigen-binding fragment thereof having a heavy chain CDR1 defined according to Kabat substantially the same as, or identical to, SEQ ID NO: 594, for example SEQ ID NO: 593. In some embodiments, the isolated polynucleotides encode an antibody or antigen-binding fragment thereof having a heavy chain CDR2 defined according to Kabat substantially the same as, or identical to, SEQ ID NO: 596, for example SEQ ID NO: 595. In some embodiments, the isolated polynucleotides encode an antibody or antigen-binding fragment thereof having a heavy chain CDR3 defined according to Kabat substantially the same as, or identical to, SEQ ID NO: 598, for example SEQ ID NO: 597. The isolated polynucleotides may encode an antibody or antigen-binding fragment thereof having a light chain with a CDR1 substantially the same as, or identical to, SEQ ID NO: 738, for example SEQ ID NO: 737; a CDR2 substantially the same as, or identical to, SEQ ID NO: 740, for example SEQ ID NO: 739; and a CDR3 substantially the same as, or identical to, SEQ ID NO: 742, for example SEQ ID NO: 741, defined according to Kabat. The isolated polynucleotides may encode an antibody or antigen-binding fragment thereof having a heavy chain CDR1 substantially the same as, or identical to, SEQ ID NO: 594, for example SEQ ID NO: 593; a CDR2 substantially the same as, or identical to, SEQ ID NO: 596, for example SEQ ID NO: 595; and a CDR3 substantially the same as, or identical to, SEQ ID NO: 598, for example SEQ ID NO: 597, defined according to Kabat. The isolated polynucleotides may encode an antibody or antigen-binding fragment thereof having a light chain CDR1 substantially the same as, or identical to, SEQ ID NO: 738, for example SEQ ID NO: 737; a CDR2 encoded by a nucleotide sequence substantially the same as, or identical to, SEQ ID NO: 740, for example SEQ ID NO: 739; and a CDR3 encoded by a nucleotide sequence substantially the same as, or identical to, SEQ ID NO: 742, for example SEQ ID NO: 741; and a heavy chain CDR1 substantially the same as, or identical to, SEQ ID NO: 594, for example SEQ ID NO: 593; a CDR2 substantially the same as, or identical to, SEQ ID NO: 596, for example SEQ ID NO: 595; and a CDR3 substantially the same as, or identical to, SEQ ID NO: 598, for example SEQ ID NO: 597, defined according to Kabat.

In some embodiments, the isolated polynucleotides encode an antibody or antigen-binding fragment thereof having a light chain CDR1 sequence defined according to IMGT substantially the same as, or identical to, SEQ ID NO: 1008, for example SEQ ID NO: 1007. In some embodiments, the isolated polynucleotides encode an antibody or antigen-binding fragment thereof having a light chain CDR2 defined according to IMGT substantially the same as, or identical to, SEQ ID NO: 1010, for example SEQ ID NO: 1009. In some embodiments, the isolated polynucleotides encode an antibody or antigen-binding fragment thereof having a light chain CDR3 defined according to IMGT substantially the same as, or identical to, SEQ ID NO: 1012, for example SEQ ID NO: 1011. In some embodiments, the isolated polynucleotides encode an antibody or antigen-binding fragment thereof having a heavy chain CDR1 defined according to IMGT substantially the same as, or identical to, SEQ ID NO: 864, for example SEQ ID NO: 863. In some embodiments, the isolated polynucleotides encode an antibody or antigen-binding fragment thereof having a heavy chain CDR2 defined according to IMGT substantially the same as, or identical to, SEQ ID NO: 866, for example SEQ ID NO: 865. In some embodiments, the isolated polynucleotides encode an antibody or antigen-binding fragment thereof having a heavy chain CDR3 defined according to IMGT substantially the same as, or identical to, SEQ ID NO: 868, for example SEQ ID NO: 867. The isolated polynucleotides may encode an antibody or antigen-binding fragment thereof having a light chain with a CDR1 substantially the same as, or identical to, SEQ ID NO: 1008, for example SEQ ID NO: 1007; a CDR2 substantially the same as, or identical to, SEQ ID NO: 1010, for example SEQ ID NO: 1009; and a CDR3 substantially the same as, or identical to, SEQ ID NO: 1012, for example SEQ ID NO: 1011, defined according to IMGT. The isolated polynucleotides may encode an antibody or antigen-binding fragment thereof having a heavy chain CDR1 substantially the same as, or identical to, SEQ ID NO: 864, for example SEQ ID NO: 863; a CDR2 substantially the same as, or identical to, SEQ ID NO: 866, for example SEQ ID NO: 865; and a CDR3 substantially the same as, or identical to, SEQ ID NO: 868, for example SEQ ID NO: 867, defined according to IMGT. The isolated polynucleotides may encode an antibody or antigen-binding fragment thereof having a light chain CDR1 substantially the same as, or identical to, SEQ ID NO: 1008, for example SEQ ID NO: 1007; a CDR2 encoded by a nucleotide sequence substantially the same as, or identical to, SEQ ID NO: 1010, for example SEQ ID NO: 1009; and a CDR3 encoded by a nucleotide sequence substantially the same as, or identical to, SEQ ID NO: 1012, for example SEQ ID NO: 1011; and a heavy chain CDR1 substantially the same as, or identical to, SEQ ID NO: 864, for example SEQ ID NO: 863; a CDR2 substantially the same as, or identical to, SEQ ID NO: 866, for example SEQ ID NO: 865; and a CDR3 substantially the same as, or identical to, SEQ ID NO: 868, for example SEQ ID NO: 867, defined according to IMGT.

In some embodiments, the isolated polynucleotides encode an antibody or antigen-binding fragment thereof having a light chain CDR1 sequence substantially the same as, or identical to, SEQ ID NO: 774, defined according to Kabat, for example SEQ ID NO: 773. In some embodiments, the isolated polynucleotides encode an antibody or antigen-binding fragment thereof having a light chain CDR2 substantially the same as, or identical to, SEQ ID NO: 776, defined according to Kabat, for example SEQ ID NO: 775. In some embodiments, the isolated polynucleotides encode an antibody or antigen-binding fragment thereof having a light chain CDR3 substantially the same as, or identical to, SEQ ID NO: 778, defined according to Kabat, for example SEQ ID NO: 777. In some embodiments, the isolated polynucleotides encode an antibody or antigen-binding fragment thereof having a heavy chain CDR1 substantially the same as, or identical to, SEQ ID NO: 642, defined according to Kabat, for example SEQ ID NO: 641. In some embodiments, the isolated polynucleotides encode an antibody or antigen-binding fragment thereof having a heavy chain CDR2 substantially the same as, or identical to, SEQ ID NO: 644, defined according to Kabat, for example SEQ ID NO: 643. In some embodiments, the isolated polynucleotides encode an antibody or antigen-binding fragment thereof having a heavy chain CDR3 substantially the same as, or identical to, SEQ ID NO: 646, defined according to Kabat, for example SEQ ID NO: 645. The isolated polynucleotides may encode an antibody or antigen-binding fragment thereof having a light chain with a CDR1 substantially the same as, or identical to, SEQ ID NO: 774, for example SEQ ID NO: 773; a CDR2 substantially the same as, or identical to, SEQ ID NO: 776, for example SEQ ID NO: 775; and a CDR3 substantially the same as, or identical to, SEQ ID NO: 778, for example SEQ ID NO: 777, defined according to Kabat. The isolated polynucleotides may encode an antibody or antigen-binding fragment thereof having a heavy chain CDR1 substantially the same as, or identical to, SEQ ID NO: 642, for example SEQ ID NO: 641; a CDR2 substantially the same as, or identical to, SEQ ID NO: 644, for example SEQ ID NO: 643; and a CDR3 substantially the same as, or identical to, SEQ ID NO: 646, for example SEQ ID NO: 645, defined according to Kabat. The isolated polynucleotides may encode an antibody or antigen-binding fragment thereof having a light chain CDR1 substantially the same as, or identical to, SEQ ID NO: 774, for example SEQ ID NO: 773; a CDR2 encoded by a nucleotide sequence substantially the same as, or identical to, SEQ ID NO: 776, for example SEQ ID NO: 775; and a CDR3 encoded by a nucleotide sequence substantially the same as, or identical to, SEQ ID NO: 778, for example SEQ ID NO: 777; and a heavy chain CDR1 substantially the same as, or identical to, SEQ ID NO: 642, for example SEQ ID NO: 641; a CDR2 substantially the same as, or identical to, SEQ ID NO: 644, for example SEQ ID NO: 643; and a CDR3 substantially the same as, or identical to, SEQ ID NO: 646, for example SEQ ID NO: 645, defined according to Kabat.

In some embodiments, the isolated polynucleotides encode an antibody or antigen-binding fragment thereof having a light chain CDR1 sequence substantially the same as, or identical to, SEQ ID NO: 1044, defined according to IMGT, for example SEQ ID NO: 1043. In some embodiments, the isolated polynucleotides encode an antibody or antigen-binding fragment thereof having a light chain CDR2 substantially the same as, or identical to, SEQ ID NO: 1046, defined according to IMGT, for example SEQ ID NO: 1045. In some embodiments, the isolated polynucleotides encode an antibody or antigen-binding fragment thereof having a light chain CDR3 substantially the same as, or identical to, SEQ ID NO: 1048, defined according to IMGT, for example SEQ ID NO: 1047. In some embodiments, the isolated polynucleotides encode an antibody or antigen-binding fragment thereof having a heavy chain CDR1 substantially the same as, or identical to, SEQ ID NO: 912, defined according to IMGT, for example SEQ ID NO: 911. In some embodiments, the isolated polynucleotides encode an antibody or antigen-binding fragment thereof having a heavy chain CDR2 substantially the same as, or identical to, SEQ ID NO: 914, defined according to IMGT, for example SEQ ID NO: 913. In some embodiments, the isolated polynucleotides encode an antibody or antigen-binding fragment thereof having a heavy chain CDR3 substantially the same as, or identical to, SEQ ID NO: 916, defined according to IMGT, for example SEQ ID NO: 915. The isolated polynucleotides may encode an antibody or antigen-binding fragment thereof having a light chain with a CDR1 substantially the same as, or identical to, SEQ ID NO: 1044, for example SEQ ID NO: 1043; a CDR2 substantially the same as, or identical to, SEQ ID NO: 1046, for example SEQ ID NO: 1045; and a CDR3 substantially the same as, or identical to, SEQ ID NO: 1048, for example SEQ ID NO: 1047, defined according to IMGT. The isolated polynucleotides may encode an antibody or antigen-binding fragment thereof having a heavy chain CDR1 substantially the same as, or identical to, SEQ ID NO: 912, for example SEQ ID NO: 911; a CDR2 substantially the same as, or identical to, SEQ ID NO: 914, for example SEQ ID NO: 913; and a CDR3 substantially the same as, or identical to, SEQ ID NO: 916, for example SEQ ID NO: 915, defined according to IMGT. The isolated polynucleotides may encode an antibody or antigen-binding fragment thereof having a light chain CDR1 substantially the same as, or identical to, SEQ ID NO: 1044, for example SEQ ID NO: 1043; a CDR2 encoded by a nucleotide sequence substantially the same as, or identical to, SEQ ID NO: 1046, for example SEQ ID NO: 1045; and a CDR3 encoded by a nucleotide sequence substantially the same as, or identical to, SEQ ID NO: 1048, for example SEQ ID NO: 1047; and a heavy chain CDR1 substantially the same as, or identical to, SEQ ID NO: 912, for example SEQ ID NO: 911; a CDR2 substantially the same as, or identical to, SEQ ID NO: 914, for example SEQ ID NO: 913; and a CDR3 substantially the same as, or identical to, SEQ ID NO: 916, for example SEQ ID NO: 915, defined according to IMGT.

In some embodiments, the isolated polynucleotides encode an antibody or antigen-binding fragment thereof having a light chain CDR1 sequence substantially the same as, or identical to, SEQ ID NO: 846, defined according to Kabat, for example SEQ ID NO: 845. In some embodiments, the isolated polynucleotides encode an antibody or antigen-binding fragment thereof having a light chain CDR2 substantially the same as, or identical to, SEQ ID NO: 848, defined according to Kabat, for example SEQ ID NO: 847. In some embodiments, the isolated polynucleotides encode an antibody or antigen-binding fragment thereof having a light chain CDR3 substantially the same as, or identical to, SEQ ID NO: 850, defined according to Kabat, for example SEQ ID NO: 849. In some embodiments, the isolated polynucleotides encode an antibody or antigen-binding fragment thereof having a heavy chain CDR1 substantially the same as, or identical to, SEQ ID NO: 732, defined according to Kabat, for example SEQ ID NO: 731. In some embodiments, the isolated polynucleotides encode an antibody or antigen-binding fragment thereof having a heavy chain CDR2 substantially the same as, or identical to, SEQ ID NO: 734, defined according to Kabat, for example SEQ ID NO: 733. In some embodiments, the isolated polynucleotides encode an antibody or antigen-binding fragment thereof having a heavy chain CDR3 substantially the same as, or identical to, SEQ ID NO: 736, defined according to Kabat, for example SEQ ID NO: 735. The isolated polynucleotides may encode an antibody or antigen-binding fragment thereof having a light chain with a CDR1 substantially the same as, or identical to, SEQ ID NO:846, for example SEQ ID NO: 845; a CDR2 substantially the same as, or identical to, SEQ ID NO: 848, for example SEQ ID NO: 847; and a CDR3 substantially the same as, or identical to, SEQ ID NO: 850, for example SEQ ID NO: 849, defined according to Kabat. The isolated polynucleotides may encode an antibody or antigen-binding fragment thereof having a heavy chain CDR1 substantially the same as, or identical to, SEQ ID NO: 732, for example SEQ ID NO: 731; a CDR2 substantially the same as, or identical to, SEQ ID NO: 734, for example SEQ ID NO: 733; and a CDR3 substantially the same as, or identical to, SEQ ID NO: 736, for example SEQ ID NO: 735, defined according to Kabat. The isolated polynucleotides may encode an antibody or antigen-binding fragment thereof having a light chain CDR1 substantially the same as, or identical to, SEQ ID NO: 846, for example SEQ ID NO: 845; a CDR2 encoded by a nucleotide sequence substantially the same as, or identical to, SEQ ID NO: 848, for example SEQ ID NO: 847; and a CDR3 encoded by a nucleotide sequence substantially the same as, or identical to, SEQ ID NO: 850, for example SEQ ID NO: 849; and a heavy chain CDR1 substantially the same as, or identical to, SEQ ID NO: 732, for example SEQ ID NO: 731; a CDR2 substantially the same as, or identical to, SEQ ID NO: 734, for example SEQ ID NO: 733; and a CDR3 substantially the same as, or identical to, SEQ ID NO: 736, for example SEQ ID NO: 735, defined according to Kabat.

In some embodiments, the isolated polynucleotides encode an antibody or antigen-binding fragment thereof having a light chain CDR1 sequence substantially the same as, or identical to, SEQ ID NO: 1116, defined according to IMGT, for example SEQ ID NO: 1115. In some embodiments, the isolated polynucleotides encode an antibody or antigen-binding fragment thereof having a light chain CDR2 substantially the same as, or identical to, SEQ ID NO: 1118, defined according to IMGT, for example SEQ ID NO: 1117. In some embodiments, the isolated polynucleotides encode an antibody or antigen-binding fragment thereof having a light chain CDR3 substantially the same as, or identical to, SEQ ID NO: 1120, defined according to IMGT, for example SEQ ID NO: 1119. In some embodiments, the isolated polynucleotides encode an antibody or antigen-binding fragment thereof having a heavy chain CDR1 substantially the same as, or identical to, SEQ ID NO: 1002, defined according to IMGT, for example SEQ ID NO: 1001. In some embodiments, the isolated polynucleotides encode an antibody or antigen-binding fragment thereof having a heavy chain CDR2 substantially the same as, or identical to, SEQ ID NO: 1004, defined according to IMGT, for example SEQ ID NO: 1003. In some embodiments, the isolated polynucleotides encode an antibody or antigen-binding fragment thereof having a heavy chain CDR3 substantially the same as, or identical to, SEQ ID NO: 1006, defined according to IMGT, for example SEQ ID NO: 1005. The isolated polynucleotides may encode an antibody or antigen-binding fragment thereof having a light chain with a CDR1 substantially the same as, or identical to, SEQ ID NO: 1116, for example SEQ ID NO: 1115; a CDR2 substantially the same as, or identical to, SEQ ID NO: 1118, for example SEQ ID NO: 1117; and a CDR3 substantially the same as, or identical to, SEQ ID NO: 1120, for example SEQ ID NO: 1119, defined according to IMGT. The isolated polynucleotides may encode an antibody or antigen-binding fragment thereof having a heavy chain CDR1 substantially the same as, or identical to, SEQ ID NO: 1002, for example SEQ ID NO: 1001; a CDR2 substantially the same as, or identical to, SEQ ID NO: 1004, for example SEQ ID NO: 1003; and a CDR3 substantially the same as, or identical to, SEQ ID NO:

1006, for example SEQ ID NO: 1005, defined according to IMGT. The isolated polynucleotides may encode an antibody or antigen-binding fragment thereof having a light chain CDR1 substantially the same as, or identical to, SEQ ID NO: 1116, for example SEQ ID NO: 1115; a CDR2 encoded by a nucleotide sequence substantially the same as, or identical to, SEQ ID NO: 1118, for example SEQ ID NO: 1117; and a CDR3 encoded by a nucleotide sequence substantially the same as, or identical to, SEQ ID NO: 1120, for example SEQ ID NO: 1119; and a heavy chain CDR1 substantially the same as, or identical to, SEQ ID NO: 1002, for example SEQ ID NO: 1001; a CDR2 substantially the same as, or identical to, SEQ ID NO: 1004, for example SEQ ID NO: 1003; and a CDR3 substantially the same as, or identical to, SEQ ID NO: 1006, for example SEQ ID NO: 1005, defined according to IMGT.

Polynucleotides described herein may encode antibodies or antigen-binding fragments that have a light chain variable domain segment that includes an amino acid sequence substantially the same as, or identical to, SEQ ID NO: 411, for example SEQ ID NO: 410. In some embodiments the described isolated polynucleotides may encode antibodies or antigen-binding fragments that have a heavy chain variable domain segment that includes an amino acid sequence substantially the same as, or identical to, SEQ ID NO: 196, for example SEQ ID NO: 195. In some embodiments the described isolated polynucleotides may encode antibodies or antigen-binding fragments that have a light chain variable domain segment that includes an amino acid sequence substantially the same as, or identical to, SEQ ID NO: 411, for example SEQ ID NO: 410; and a heavy chain variable domain segment that includes an amino acid sequence substantially the same as, or identical to, SEQ ID NO: 196, for example SEQ ID NO: 195. The isolated polynucleotides capable of encoding the variable domain segments provided herein may be included on the same, or different, vectors to produce antibodies or antigen-binding fragments.

Polynucleotides described herein may encode antibodies or antigen-binding fragments that have a light chain variable domain segment that includes an amino acid sequence substantially the same as, or identical to, SEQ ID NO: 465, for example SEQ ID NO: 464. In some embodiments the described isolated polynucleotides may encode antibodies or antigen-binding fragments that have a heavy chain variable domain segment that includes an amino acid sequence substantially the same as, or identical to, SEQ ID NO: 268, for example SEQ ID NO: 267. In some embodiments the described isolated polynucleotides may encode antibodies or antigen-binding fragments that have a light chain variable domain segment that includes an amino acid sequence substantially the same as, or identical to, SEQ ID NO: 465, for example SEQ ID NO: 464; and a heavy chain variable domain segment that includes an amino acid sequence substantially the same as, or identical to, SEQ ID NO: 268, for example SEQ ID NO: 267. The isolated polynucleotides capable of encoding the variable domain segments provided herein may be included on the same, or different, vectors to produce antibodies or antigen-binding fragments.

Polynucleotides described herein may encode antibodies or antigen-binding fragments that have a light chain variable domain segment that includes an amino acid sequence substantially the same as, or identical to, SEQ ID NO: 581, for example SEQ ID NO: 580. In some embodiments the described isolated polynucleotides may encode antibodies or antigen-binding fragments that have a heavy chain variable domain segment that includes an amino acid sequence substantially the same as, or identical to, SEQ ID NO: 268, for example SEQ ID NO: 267. In some embodiments the described isolated polynucleotides may encode antibodies or antigen-binding fragments that have a light chain variable domain segment that includes an amino acid sequence substantially the same as, or identical to, SEQ ID NO: 581, for example SEQ ID NO: 580; and a heavy chain variable domain segment that includes an amino acid sequence substantially the same as, or identical to, SEQ ID NO: 268, for example SEQ ID NO: 267. The isolated polynucleotides capable of encoding the variable domain segments provided herein may be included on the same, or different, vectors to produce antibodies or antigen-binding fragments.

Polynucleotides described herein may encode antibodies or antigen-binding fragments that have a light chain variable domain segment that includes an amino acid sequence substantially the same as, or identical to, SEQ ID NO: 545, for example SEQ ID NO: 544. In some embodiments the described isolated polynucleotides may encode antibodies or antigen-binding fragments that have a heavy chain variable domain segment that includes an amino acid sequence substantially the same as, or identical to, SEQ ID NO: 384, for example SEQ ID NO: 383. In some embodiments the described isolated polynucleotides may encode antibodies or antigen-binding fragments that have a light chain variable domain segment that includes an amino acid sequence substantially the same as, or identical to, SEQ ID NO: 545, for example SEQ ID NO: 544; and a heavy chain variable domain segment that includes an amino acid sequence substantially the same as, or identical to, SEQ ID NO: 384, for example SEQ ID NO: 383. The isolated polynucleotides capable of encoding the variable domain segments provided herein may be included on the same, or different, vectors to produce antibodies or antigen-binding fragments.

Polynucleotides described herein may encode antibodies or antigen-binding fragments that have a light chain variable domain segment that includes an amino acid sequence substantially the same as, or identical to, SEQ ID NO: 545, for example SEQ ID NO: 544. In some embodiments the described isolated polynucleotides may encode antibodies or antigen-binding fragments that have a heavy chain variable domain segment that includes an amino acid sequence substantially the same as, or identical to, SEQ ID NO: 393, for example SEQ ID NO: 392. In some embodiments the described isolated polynucleotides may encode antibodies or antigen-binding fragments that have a light chain variable domain segment that includes an amino acid sequence substantially the same as, or identical to, SEQ ID NO: 545, for example SEQ ID NO: 544; and a heavy chain variable domain segment that includes an amino acid sequence substantially the same as, or identical to, SEQ ID NO: 393, for example SEQ ID NO: 392. The isolated polynucleotides capable of encoding the variable domain segments provided herein may be included on the same, or different, vectors to produce antibodies or antigen-binding fragments.

Polynucleotides described herein may encode antibodies or antigen-binding fragments that have a light chain variable domain segment that includes an amino acid sequence substantially the same as, or identical to, SEQ ID NO: 545, for example SEQ ID NO: 544. In some embodiments the described isolated polynucleotides may encode antibodies or antigen-binding fragments that have a heavy chain variable domain segment that includes an amino acid sequence substantially the same as, or identical to, SEQ ID NO: 402, for example SEQ ID NO: 401. In some embodiments the described isolated polynucleotides may encode antibodies or antigen-binding fragments that have a light chain variable domain segment that includes an amino acid sequence substantially the same as, or identical to, SEQ ID NO: 545, for example SEQ ID NO: 544; and a heavy chain variable domain segment that includes an amino acid sequence substantially the same as, or identical to, SEQ ID NO: 402, for example SEQ ID NO: 401. The isolated polynucleotides capable of encoding the variable domain segments provided herein may be included on the same, or different, vectors to produce antibodies or antigen-binding fragments.

Polynucleotides described herein may encode antibodies or antigen-binding fragments that have a light chain variable domain segment that includes an amino acid sequence substantially the same as, or identical to, SEQ ID NO: 572, for example SEQ ID NO:571. In some embodiments the described isolated polynucleotides may encode antibodies or antigen-binding fragments that have a heavy chain variable domain segment that includes an amino acid sequence substantially the same as, or identical to, SEQ ID NO: 384, for example SEQ ID NO: 383. In some embodiments the described isolated polynucleotides may encode antibodies or antigen-binding fragments that have a light chain variable domain segment that includes an amino acid sequence substantially the same as, or identical to, SEQ ID NO: 572, for example SEQ ID NO: 571; and a heavy chain variable domain segment that includes an amino acid sequence substantially the same as, or identical to, SEQ ID NO: 384, for example SEQ ID NO: 383. The isolated polynucleotides capable of encoding the variable domain segments provided herein may be included on the same, or different, vectors to produce antibodies or antigen-binding fragments.

Polynucleotides described herein may encode antibodies or antigen-binding fragments that have a light chain variable domain segment that includes an amino acid sequence substantially the same as, or identical to, SEQ ID NO: 572, for example SEQ ID NO: 571. In some embodiments the described isolated polynucleotides may encode antibodies or antigen-binding fragments that have a heavy chain variable domain segment that includes an amino acid sequence substantially the same as, or identical to, SEQ ID NO: 393, for example SEQ ID NO: 392. In some embodiments the described isolated polynucleotides may encode antibodies or antigen-binding fragments that have a light chain variable domain segment that includes an amino acid sequence substantially the same as, or identical to, SEQ ID NO: 572, for example SEQ ID NO: 571; and a heavy chain variable domain segment that includes an amino acid sequence substantially the same as, or identical to, SEQ ID NO: 393, for example SEQ ID NO: 392. The isolated polynucleotides capable of encoding the variable domain segments provided herein may be included on the same, or different, vectors to produce antibodies or antigen-binding fragments.

Polynucleotides described herein may encode antibodies or antigen-binding fragments that have a light chain variable domain segment that includes an amino acid sequence substantially the same as, or identical to, SEQ ID NO: 572, for example SEQ ID NO: 571. In some embodiments the described isolated polynucleotides may encode antibodies or antigen-binding fragments that have a heavy chain variable domain segment that includes an amino acid sequence substantially the same as, or identical to, SEQ ID NO: 402, for example SEQ ID NO: 401. In some embodiments the described isolated polynucleotides may encode antibodies or antigen-binding fragments that have a light chain variable domain segment that includes an amino acid sequence substantially the same as, or identical to, SEQ ID NO: 572, for example SEQ ID NO: 571; and a heavy chain variable domain segment that includes an amino acid sequence substantially the same as, or identical to, SEQ ID NO: 402, for example SEQ ID NO: 401. The isolated polynucleotides capable of encoding the variable domain segments provided herein may be included on the same, or different, vectors to produce antibodies or antigen-binding fragments.

The polynucleotides capable of encoding the variable domain segments provided herein may be included on the same, or different, vectors to produce antibodies or antigen-binding fragments. Polynucleotides encoding engineered antigen-binding proteins also are within the scope of the disclosure. In some embodiments, the polynucleotides described (and the peptides they encode) include a leader sequence. Any leader sequence known in the art may be employed. The leader sequence may include, but is not limited to, a restriction site or a translation start site.

Also provided are vectors comprising the polynucleotides described herein. The vectors can be expression vectors. Recombinant expression vectors containing a sequence encoding a polypeptide of interest are thus contemplated as within the scope of this disclosure. The expression vector may contain one or more additional sequences such as but not limited to regulatory sequences (e.g., promoter, enhancer), a selection marker, and a polyadenylation signal. Vectors for transforming a wide variety of host cells are well known and include, but are not limited to, plasmids, phagemids, cosmids, baculoviruses, bacmids, bacterial artificial chromosomes (BACs), yeast artificial chromosomes (YACs), as well as other bacterial, yeast and viral vectors.

Recombinant expression vectors within the scope of the description include synthetic, genomic, or cDNA-derived nucleic acid fragments that encode at least one recombinant protein which may be operably linked to suitable regulatory elements. Such regulatory elements may include a transcriptional promoter, sequences encoding suitable mRNA ribosomal binding sites, and sequences that control the termination of transcription and translation. Expression vectors, especially mammalian expression vectors, may also include one or more nontranscribed elements such as an origin of replication, a suitable promoter and enhancer linked to the gene to be expressed, other 5' or 3' flanking nontranscribed sequences, 5' or 3' nontranslated sequences (such as necessary ribosome binding sites), a polyadenylation site, splice donor and acceptor sites, or transcriptional termination sequences. An origin of replication that confers the ability to replicate in a host may also be incorporated.

The transcriptional and translational control sequences in expression vectors to be used in transforming vertebrate cells may be provided by viral sources. Exemplary vectors may be constructed as described by Okayama and Berg, 3 Mol. Cell. Biol. 280 (1983).

In some embodiments, the antibody- or antigen-binding fragment-coding sequence is placed under control of a powerful constitutive promoter, such as the promoters for the following genes: hypoxanthine phosphoribosyl transferase (HPRT), adenosine deaminase, pyruvate kinase, beta-actin, human myosin, human hemoglobin, human muscle creatine, and others. In addition, many viral promoters function constitutively in eukaryotic cells and are suitable for use with the described embodiments. Such viral promoters include without limitation, Cytomegalovirus (CMV) immediate early promoter, the early and late promoters of SV40, the Mouse Mammary Tumor Virus (MMTV) promoter, the long terminal repeats (LTRs) of Maloney leukemia virus, Human Immunodeficiency Virus (HIV), Epstein Barr Virus (EBV), Rous Sarcoma Virus (RSV), and other retroviruses, and the thymidine kinase promoter of Herpes Simplex Virus. In one embodiment, the antibody or antigen-binding fragment thereof coding sequence is placed under control of an inducible promoter such as the metallothionein promoter, tetracycline-inducible promoter, doxycycline-inducible promoter, promoters that contain one or more interferon-stimulated response elements (ISRE) such as protein kinase R 2',5'-oligoadenylate synthetases, Mx genes, ADAR1, and the like.

Vectors described herein may contain one or more Internal Ribosome Entry Site(s) (IRES). Inclusion of an IRES sequence into fusion vectors may be beneficial for enhancing expression of some proteins. In some embodiments the vector system will include one or more polyadenylation sites (e.g., SV40), which may be upstream or downstream of any of the aforementioned nucleic acid sequences. Vector components may be contiguously linked, or arranged in a manner that provides optimal spacing for expressing the gene products (i.e., by the introduction of "spacer" nucleotides between the ORFs), or positioned in another way. Regulatory elements, such as the IRES motif, may also be arranged to provide optimal spacing for expression.

The vectors may comprise selection markers, which are well known in the art. Selection markers include positive and negative selection markers, for example, antibiotic resistance genes (e.g., neomycin resistance gene, a hygromycin resistance gene, a kanamycin resistance gene, a tetracycline resistance gene, a penicillin resistance gene), glutamate sythase genes, HSV-TK, HSV-TK derivatives for ganciclovir selection, or bacterial purine nucleoside phosphorylase gene for 6-methylpurine selection (Gadi et al., 7 Gene Ther. 1738-1743 (2000)). A nucleic acid sequence encoding a selection marker or the cloning site may be upstream or downstream of a nucleic acid sequence encoding a polypeptide of interest or cloning site.

The vectors described herein may be used to transform various cells with the genes encoding the described antibodies or antigen-binding fragments. For example, the vectors may be used to generate antibody or antigen-binding fragment-producing cells. Thus, another aspect features host cells transformed with vectors comprising a nucleic acid sequence encoding an antibody or antigen-binding fragment thereof that specifically binds Tau, such as the antibodies or antigen-binding fragments described and exemplified herein.

Numerous techniques are known in the art for the introduction of foreign genes into cells and may be used to construct the recombinant cells for purposes of carrying out the described methods, in accordance with the various embodiments described and exemplified herein. The technique used should provide for the stable transfer of the heterologous gene sequence to the host cell, such that the heterologous gene sequence is heritable and expressible by the cell progeny, and so that the necessary development and physiological functions of the recipient cells are not disrupted. Techniques which may be used include but are not limited to chromosome transfer (e.g., cell fusion, chromosome mediated gene transfer, micro cell mediated gene transfer), physical methods (e.g., transfection, spheroplast fusion, microinjection, electroporation, liposome carrier), viral vector transfer (e.g., recombinant DNA viruses, recombinant RNA viruses) and the like (described in Cline, 29 Pharmac. Ther. 69-92 (1985)). Calcium phosphate precipitation and polyethylene glycol (PEG)-induced fusion of bacterial protoplasts with mammalian cells may also be used to transform cells.

Cells suitable for use in the expression of the antibodies or antigen-binding fragments described herein are preferably eukaryotic cells, more preferably cells of plant, rodent, or human origin, for example but not limited to NS0, CHO, CHOK1, perC.6, Tk-ts13, BHK, HEK293 cells, COS-7, T98G, CV-1/EBNA, L cells, C127, 3T3, HeLa, NS1, and Sp2/0 myeloma cells cell lines, among others. In addition, expression of antibodies may be accomplished using hybridoma cells. Methods for producing hybridomas are well established in the art.

Cells transformed with expression vectors described herein may be selected or screened for recombinant expression of the antibodies or antigen-binding fragments described herein. Recombinant-positive cells are expanded and screened for subclones exhibiting a desired phenotype, such as high level expression, enhanced growth properties, or the ability to yield proteins with desired biochemical characteristics, for example, due to protein modification or altered post-translational modifications. These phenotypes may be due to inherent properties of a given subclone or to mutation. Mutations may be effected through the use of chemicals, UV-wavelength light, radiation, viruses, insertional mutagens, inhibition of DNA mismatch repair, or a combination of such methods.

In certain embodiments, an isolated cell line expressing any of the anti-Tau antibodies described herein are provided. In one embodiment, the isolated cell line is a hybridoma. In one embodiment, the isolated cell line is the hybridoma from which monoclonal antibody 7G6 is produced. In one embodiment, the isolated cell line is Freestyle® 293-F cells from which 7G6-HCzu8-LCzu6-HEK is produced and which cell line has been deposited with the American Type Culture Collection, Manassas, Va., USA, on Oct. 11, 2017, with the ATCC Patent Deposit Designation PTA-124523. In one embodiment, the isolated cell line is Freestyle® 293-F cells from which 7G6-HCzu25-LCzu18-HEK is produced and which cell line has been deposited with the American Type Culture Collection, Manassas, Va., USA, on Oct. 11, 2017, with the ATCC Patent Deposit Designation PTA-124524.

Cells that express the provided anti-Tau antibodies or antigen-binding fragments provided herein may be employed in methods of producing the anti-Tau antibodies or antigen-binding fragments by culturing the cells under conditions suitable for expression of the respective antibody or antigen-binding fragment. In some embodiments, the anti-Tau antibody or antigen-binding fragment is recovered from the culture medium.

In certain embodiments, any of the antibodies or antigen-binding fragments that specifically bind Tau as provided herein is useful for detecting the presence of Tau in a biological sample. The term "detecting" as used herein encompasses quantitative or qualitative detection. In certain embodiments, the biological sample may be derived from a cell or tissue, such as cerebrospinal fluid, a cell or tissue of the brain (e.g., cortex or hippocampus), or blood, a histological preparation, and the like. In some embodiments the described methods include detecting Tau in a sample by contacting the biological sample with:

(a) any one of antibody ms7G6, antibody 7G6-HCzu8-LCzu6, antibody 7G6-HCzu8-LCzu21, antibody 7G6-HCzu23-LCzu15, antibody 7G6-HCzu24-LCzu15, antibody 7G6-HCzu25-LCzu15, antibody 7G6-HCzu23-LCzu18, antibody 7G6-HCzu24-LCzu18, antibody 7G6-HCzu25-LCzu18, or an antigen-binding fragment thereof;

(b) an antibody, or antigen-binding fragment thereof, that comprises heavy chain CDR1, CDR2, and CDR3 amino acid sequences and light chain CDR1, CDR2, and CDR3 amino acid sequences of antibody ms7G6, antibody 7G6-HCzu8-LCzu6, or antibody 7G6-HCzu25-LCzu18, as described in Table 1;

(c) an antibody, or antigen-binding fragment thereof, that comprises the heavy chain variable domain segment and light chain variable domain segment of any one of antibody ms7G6, antibody 7G6-HCzu8/LCzu6, antibody 7G6-HCzu8/LCzu21, antibody 7G6-HCzu23/LCzu15, antibody 7G6-HCzu24/LCzu15, antibody 7G6-HCzu25/LCzu15, antibody 7G6-HCzu23/LCzu18, antibody 7G6-HCzu24/LCzu18, or antibody 7G6-HCzu25/LCzu18, as described in Table 1; or (d) an antibody having the amino acid sequence of antibody produced by any one of the cell lines deposited with the ATCC having accession number PTA-124523 or PTA-124524, or an antigen binding fragment thereof.

In certain embodiments, the method comprises contacting the biological sample with an anti-Tau antibody as provided herein under conditions permissive for binding of the anti-Tau antibody to Tau, and detecting whether a complex is formed between the anti-Tau antibody and Tau. In some embodiments of these methods, the anti-Tau antibody is detectably labelled. The method may be an in vitro or in vivo method. The complex formed between the anti-Tau antibody and Tau in a test biological sample can be compared to the complex formed in a control biological sample (e.g., a biological sample from a healthy subject). The amount of the complex formed between the anti-Tau antibody and Tau in a test biological sample can also be quantified and compared to the amount of the complex formed in a control biological sample or to the average amount of the complex known to be formed in healthy subjects.

In a further aspect, the invention provides pharmaceutical formulations comprising any of the antibodies or antigen-binding fragments that specifically bind Tau as described herein, e.g., for use in any of the therapeutic methods provided herein. In some embodiments, a pharmaceutical formulation comprises any of the antibodies or antigen-binding fragments that specifically bind Tau provided herein and a pharmaceutically acceptable carrier.

Pharmaceutical formulations of an anti-Tau antibody or antigen-binding fragment as described herein are prepared by mixing such antibody or antigen-binding fragment having the desired degree of purity with one or more optional pharmaceutically acceptable carriers, diluents, and/or excipients (Remington's Pharmaceutical Sciences 16th edition, Osol, A. Ed. (1980)), in the form of lyophilized formulations or aqueous solutions. Pharmaceutically acceptable carriers, diluents, and excipients are generally nontoxic to recipients at the dosages and concentrations employed, and include, but are not limited to: sterile water, buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Exemplary pharmaceutically acceptable carriers herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX™, Baxter International, Inc.). Certain exemplary sHASEGPs and methods of use, including rHuPH20, are described in U.S. Pat. No. 7,871,607 and U.S. Publication No. 2006/0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171,586 and WO2006/044908, the latter formulations including a histidine-acetate buffer.

The anti-Tau antibody or antigen-binding fragment as an active ingredient in a pharmaceutical formulation may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

Sustained-release preparations may be prepared. Suitable examples of sustained-release preparations include semipermeable matrices of solid hydrophobic polymers containing the antibody, which matrices are in the form of shaped articles, e.g. films, or microcapsules.

The formulations to be used for in vivo administration are generally sterile. Sterility may be readily accomplished, e.g., by filtration through sterile filtration membranes.

Any of the antibodies or antigen-binding fragments that specifically bind Tau (or formulations thereof) provided herein may be used in therapeutic methods.

In one aspect, an anti-Tau antibody or antigen-binding fragment for use as a medicament is provided. In some embodiments, an anti-Tau antibody or antigen-binding fragment for use in the reduction of insoluble Tau is provided. In some embodiments, an anti-Tau antibody or antigen-binding fragment for use in inhibiting Tau aggregation is provided. In further aspects, an anti-Tau antibody or antigen-binding fragment for use in treating a Tauopathy is provided. Exemplary Tauopathies that can be treated with the disclosed anti-Tau antibodies or antigen-binding fragments include Alzheimer's disease (AD), progressive supranuclear palsy (PSP), and frontotemporal dementia (FTD). An exemplary FTD that can be treated is Pick's disease (PiD).

In certain embodiments, an anti-Tau antibody or antigen-binding fragment for use in a method of treatment is provided. In some embodiments, an anti-Tau antibody or antigen-binding fragment for use in a method of reducing insoluble Tau in a subject is provided. In some embodiments, an anti-Tau antibody or antigen-binding fragment for use in a method of inhibiting Tau aggregation in a subject is provided. In certain embodiments, an anti-Tau antibody or antigen-binding fragment for use in a method of treating a subject having a Tauopathy is provided. The method of treatment of a Tauopathy comprises administering to the subject the anti-Tau antibody or antigen-binding fragment in an amount effective to treat the Tauopathy. In certain embodiments, the Tauopathy is any one of the Tauopathies described above. In preferred embodiments, the subject is a mammal, preferably a human.

In a further aspect, also provided herein is the use of an anti-Tau antibody or antigen-binding fragment as described herein in the manufacture or preparation of a medicament. In some embodiments, the medicament is for reduction of insoluble Tau. In some embodiments, the medicament is for inhibition of Tau aggregation. In some embodiments, the medicament is for treatment of a Tauopathy. In certain embodiments, the Tauopathy is any one of the Tauopathies described above.

An anti-Tau antibody or antigen-binding fragment as described herein can be administered by any suitable means, including parenteral, intrapulmonary, and intranasal, and, if desired for local treatment, intralesional administration. Parenteral infusions include intramuscular, intravenous, intraarterial, intraperitoneal, or subcutaneous administration. Dosing can be by any suitable route, e.g. by injections, such as intravenous or subcutaneous injections, depending in part on whether the administration is brief or chronic. Various dosing schedules including but not limited to single or multiple administrations over various time-points, bolus administration, and pulse infusion are contemplated herein.

The anti-Tau antibodies or antigen-binding fragments provided herein are to be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

For the prevention or treatment of disease, the appropriate dosage of the anti-Tau antibody or antigen-binding fragment will depend on the type of disease to be treated, the type of antibody, the severity and course of the disease, whether the antibody or antigen-binding fragment is administered for preventive or therapeutic purposes, previous therapy, the patient's clinical history and response to the antibody, and the discretion of the attending physician. The antibody or antigen-binding fragment is suitably administered to the patient at one time or over a series of treatments. Depending on the type and severity of the disease, about 1 µg/kg to 15 mg/kg of antibody or antigen-binding fragment can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the antibody or antigen-binding fragment would be in the range from about 0.05 mg/kg to about 100 mg/kg. Thus, one or more doses of about 0.5 mg/kg, 2.0 mg/kg, 10 mg/kg, 30 mg/kg, or 100 mg/kg (or any combination thereof) may be administered to the patient. Such doses may be administered intermittently, for example, every week or every three weeks (e.g. such that the patient receives from about two to about twenty, or e.g. about six doses of the antibody). An initial higher loading dose, followed by one or more lower doses may be administered. However, other dosage regimens may be useful. The progress of this therapy may be monitored by conventional techniques and assays.

Also provided herein is an article of manufacture containing material(s) useful for the treatment, prevention and/or diagnosis of the disorders described above. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper pierceable by a hypodermic injection needle). The active agent in the composition is an anti-Tau antibody or antigen-binding fragment as described herein. The label or package insert indicates that the composition is used for treating the condition of choice. Alternatively, or additionally, the article of manufacture may further comprise a second container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

ILLUSTRATIVE EMBODIMENTS

Provided here are illustrative embodiments of the disclosed technology. These embodiments are illustrative only and do not limit the scope of the present disclosure or of the claims attached hereto.

Embodiment 1

A monoclonal antibody, or an antigen-binding fragment thereof, that specifically binds a human Tau, the antibody comprising:
a heavy chain complementarity determining region 1 (HCDR1), a heavy chain complementarity determining region 2 (HCDR2), and a heavy chain complementarity determining region 3 (HCDR3) as set forth in SEQ ID NO: 196 and a light chain complementarity determining region 1 (LCDR1), a light chain complementarity determining region 2 (LCDR2), and a light chain complementarity determining region 3 (LCDR3) as set forth in SEQ ID NO: 411;
a HCDR1, a HCDR2, and a HCDR3 as set forth in SEQ ID NO: 268 and a LCDR1, a LCDR2, and a LCDR3 as set forth in SEQ ID NO: 465; or
a HCDR1, a HCDR2, and a HCDR3 as set forth in SEQ ID NO: 402 and a LCDR1, a LCDR2, and a LCDR3 as set forth in SEQ ID NO: 572.

Embodiment 2

The monoclonal antibody or antigen-binding fragment according to Embodiment 1, wherein:
the HCDR1 comprises SEQ ID NO: 594, the HCDR2 comprises SEQ ID NO: 596, the HCDR3 comprises SEQ ID NO: 598, the LCDR1 comprises SEQ ID NO: 738, the LCDR2 comprises SEQ ID NO: 740, and the LCDR3 comprises SEQ ID NO: 742 as defined according to the method of Kabat;
the HCDR1 comprises SEQ ID NO: 864, the HCDR2 comprises SEQ ID NO: 866, the HCDR3 comprises SEQ ID NO: 868, the LCDR1 comprises SEQ ID NO: 1008, the LCDR2 comprises SEQ ID NO: 1010, and the LCDR3 comprises SEQ ID NO: 1012 as defined by IMGT;
the HCDR1 comprises SEQ ID NO: 642, the HCDR2 comprises SEQ ID NO: 644, the HCDR3 comprises SEQ ID NO: 646, the LCDR1 comprises SEQ ID NO: 774, the LCDR2 comprises SEQ ID NO: 776, and the LCDR3 comprises SEQ ID NO: 778 as defined according to the method of Kabat;

the HCDR1 comprises SEQ ID NO: 912, the HCDR2 comprises SEQ ID NO: 914, the HCDR3 comprises SEQ ID NO: 916, the LCDR1 comprises SEQ ID NO: 1044, the LCDR2 comprises SEQ ID NO: 1046, and the LCDR3 comprises SEQ ID NO: 1048 as defined by IMGT;

the HCDR1 comprises SEQ ID NO: 732, the HCDR2 comprises SEQ ID NO: 734, the HCDR3 comprises SEQ ID NO: 736, the LCDR1 comprises SEQ ID NO: 846, the LCDR2 comprises SEQ ID NO: 848, and the LCDR3 comprises SEQ ID NO: 850 as defined according to the method of Kabat; or the HCDR1 comprises SEQ ID NO: 1002, the HCDR2 comprises SEQ ID NO: 1004, the HCDR3 comprises SEQ ID NO: 1006, the LCDR1 comprises SEQ ID NO: 1116, the LCDR2 comprises SEQ ID NO: 1118, and the LCDR3 comprises SEQ ID NO: 1120 as defined by IMGT.

Embodiment 3

The monoclonal antibody or antigen-binding fragment according to Embodiment 1 or 2, wherein the residue at position 49 of the light chain according to the method of Kabat is not cysteine.

Embodiment 4

The monoclonal antibody or antigen-binding fragment according to Embodiment 3, wherein the residue at position 49 of the light chain according to the method of Kabat is serine.

Embodiment 5

The monoclonal antibody or antigen-binding fragment according to any preceding Embodiment wherein the residue at position 57 of the heavy chain according to the method of Kabat is not cysteine.

Embodiment 6

The monoclonal antibody or antigen-binding fragment according to Embodiment 5, wherein the residue at position 57 of the heavy chain according to the method of Kabat is serine.

Embodiment 7

The monoclonal antibody or antigen-binding fragment according to any preceding Embodiment wherein the residue at position 34 of the light chain according to the method of Kabat is glutamate.

Embodiment 8

The monoclonal antibody or antigen-binding fragment according to any preceding Embodiment wherein the residue at position 36 of the light chain according to the method of Kabat is not phenylalanine.

Embodiment 9

The monoclonal antibody or antigen-binding fragment according to Embodiment 8 wherein the residue at position 36 of the light chain according to the method of Kabat is tyrosine.

Embodiment 10

The monoclonal antibody or antigen-binding fragment according to any preceding Embodiment wherein the residue at position 46 of the light chain according to the method of Kabat is not arginine.

Embodiment 11

The monoclonal antibody or antigen-binding fragment according to Embodiment 10 wherein the residue at position 46 of the light chain according to the method of Kabat is leucine.

Embodiment 12

The monoclonal antibody or antigen-binding fragment according to any preceding Embodiment wherein the residue at position 94 of the heavy chain according to the method of Kabat is not lysine.

Embodiment 13

The monoclonal antibody or antigen-binding fragment according to any preceding Embodiment wherein the residue at position 71 of the heavy chain according to the method of Kabat is not arginine.

Embodiment 14

The monoclonal antibody or antigen-binding fragment according to the method of Embodiment 13 wherein position 71 of the heavy chain according to the Kabat method is valine.

Embodiment 15

The monoclonal antibody or antigen-binding fragment according to Embodiment 1 or Embodiment 2, the antibody comprising:
  a heavy chain variable domain (HCVD) comprising SEQ ID NO: 268 and a light chain variable domain (LCVD) comprising SEQ ID NO: 465;
  a HCVD comprising SEQ ID NO: 268 and a LCVD comprising SEQ ID NO: 581;
  a HCVD comprising SEQ ID NO: 384 and a LCVD comprising SEQ ID NO: 545;
  a HCVD comprising SEQ ID NO: 393 and a LCVD comprising SEQ ID NO: 545;
  a HCVD comprising SEQ ID NO: 402 and a LCVD comprising SEQ ID NO: 545;
  a HCVD comprising SEQ ID NO: 384 and a LCVD comprising SEQ ID NO: 572;
  a HCVD comprising SEQ ID NO: 393 and a LCVD comprising SEQ ID NO: 572; or
  a HCVD comprising SEQ ID NO: 402 and a LCVD comprising SEQ ID NO: 572.

Embodiment 16

The monoclonal antibody or antigen-binding fragment according to any preceding Embodiment, wherein the antibody is produced by the cell line having ATCC deposit number PTA-124523.

Embodiment 17

The monoclonal antibody or antigen-binding fragment according to any one of Embodiments 1 to 15, wherein the antibody is produced by the cell line having ATCC deposit number PTA-124524.

Embodiment 18

The monoclonal antibody or antigen-binding fragment according to any preceding Embodiment, wherein the antibody is a murine antibody, a chimeric antibody, or a humanized antibody.

Embodiment 19

The monoclonal antibody or antigen-binding fragment according to any preceding Embodiment wherein the antibody is IgG1.

Embodiment 20

The monoclonal antibody or antigen-binding fragment according to any preceding Embodiment wherein the antibody binds monomeric wild-type human 2N4R Tau with a $K_D$ of less than about 0.5 nM as measured by surface plasmon resonance.

Embodiment 21

The monoclonal antibody or antigen-binding fragment according to any preceding Embodiment, wherein the antibody or antigen-binding fragment binds to human Tau at an epitope comprising the amino acid sequence HVPG (SEQ ID NO: 1133).

Embodiment 22

The monoclonal antibody or antigen-binding fragment according to Embodiment 21, wherein the antibody or antigen-binding fragment is biepitopic and binds to human Tau at an epitope comprising the amino acid sequence HVPG (SEQ ID NO: 1133) within repeat region 2 or repeat region 4.

Embodiment 23

The monoclonal antibody or antigen-binding fragment according to any one of Embodiments 1 to 20, wherein the antibody or antigen-binding fragment binds to human Tau at an epitope comprising the amino acid sequence HVPGG (SEQ ID NO: 79).

Embodiment 24

The monoclonal antibody or antigen-binding fragment according to Embodiment 23, wherein the antibody or antigen-binding fragment is biepitopic and binds to human Tau at an epitope comprising the amino acid sequence HVPGG (SEQ ID NO: 79) within repeat region 2 or repeat region 4.

Embodiment 25

The monoclonal antibody or antigen-binding fragment according to any preceding Embodiment,
wherein the antibody or antigen-binding fragment binds human Tau at the epitope comprising the amino acid sequence HVPGG (SEQ ID NO: 79) within repeat region 2 with a binding preference that is at least about 10-fold greater than binding at an epitope comprising the amino acid sequence HKPGG (SEQ ID NO: 182) within repeat region 3 or than binding at an epitope comprising the amino acid sequence HQPGG (SEQ ID NO: 183) within repeat region 1, or wherein the antibody or antigen-binding fragment binds human Tau at the epitope comprising the amino acid sequence HVPGG (SEQ ID NO: 79) within repeat region 4 with a binding preference that is at least about 10-fold greater than binding at an epitope comprising the amino acid sequence HKPGG (SEQ ID NO: 182) within repeat region 3 or than binding at an epitope comprising the amino acid sequence HQPGG (SEQ ID NO: 183) within repeat region 1, as determined by a peptide binding assay.

Embodiment 26

The monoclonal antibody or antigen-binding fragment according to any preceding Embodiment wherein the antibody or antigen-binding fragment does not bind Tau at an epitope comprising the amino acid sequence HVSGG (SEQ ID NO: 184) within repeat region 2 or at an epitope comprising the amino acid sequence HVLGG (SEQ ID NO: 185) within repeat region 2.

Embodiment 27

A labeled antibody or antigen-binding fragment comprising the antibody or antigen-binding fragment according to any preceding Embodiment.

Embodiment 28

A nucleic acid molecule encoding the monoclonal antibody or antigen-binding fragment of any one of Embodiments 1 to 26.

Embodiment 29

A vector comprising the nucleic acid molecule of Embodiment 28.

Embodiment 30

A cell that expresses the nucleic acid molecule of Embodiment 28.

Embodiment 31

A method of producing an anti-Tau antibody or antigen-binding fragment comprising culturing a cell according to Embodiment 30 under conditions suitable for producing the antibody or antigen-binding fragment.

Embodiment 32

The method according to Embodiment 31 further comprising recovering the antibody or antigen-binding fragment.

Embodiment 33

A pharmaceutical composition comprising the antibody or antigen-binding fragment of any one of Embodiments 1 to 26 and a pharmaceutically acceptable carrier.

Embodiment 34

The antibody or antigen-binding fragment according to any one of Embodiments 1 to 26 for use as a medicament.

Embodiment 35

The antibody or antigen-binding fragment according to any one of Embodiments 1 to 26 for use in the treatment of a Tauopathy.

Embodiment 36

The antibody or antigen-binding fragment according to any one of Embodiments 1 to 26 for use in the preparation of a medicament for the treatment of a Tauopathy.

Embodiment 37

The antibody for use in accordance with Embodiment 35 or 36 wherein the Tauopathy is Alzheimer's disease, frontotemporal dementia, or progressive supranuclear palsy.

Embodiment 38

The antibody for use in accordance with Embodiment 37 wherein the frontotemporal dementia is Pick's Disease.

Embodiment 39

A method for decreasing sarkosyl-insoluble Tau levels, the method comprising administering to the subject the monoclonal antibody or antigen-binding fragment of any one of Embodiments 1 to 26.

Embodiment 40

A method for inhibiting Tau aggregation, the method comprising administering to the subject the monoclonal antibody or antigen-binding fragment of any one of Embodiments 1 to 26.

Embodiment 41

The method according to Embodiment 39 or 40 wherein the method is performed in vitro or in vivo.

Embodiment 42

A method of treating a Tauopathy in a subject, the method comprising: administering to the subject the monoclonal antibody or antigen-binding fragment of any one of Embodiments 1 to 26 under conditions effective to treat the Tauopathy in the subject.

Embodiment 43

The method according to Embodiment 42, wherein the Tauopathy is Alzheimer's disease, frontotemporal dementia, or progressive supranuclear palsy.

Embodiment 44

The method according to Embodiment 43 wherein the frontotemporal dementia is Pick's disease.

The following examples are provided to supplement the prior disclosure and to provide a better understanding of the subject matter described herein. These examples should not be considered to limit the described subject matter. It is understood that the examples and embodiments described herein are for illustrative purposes only and that various modifications or changes in light thereof will be apparent to persons skilled in the art and are to be included within the scope of the invention and can be made without departing from the true scope of the invention.

Example 1: Generation of Monoclonal Antibodies

Figure 2:
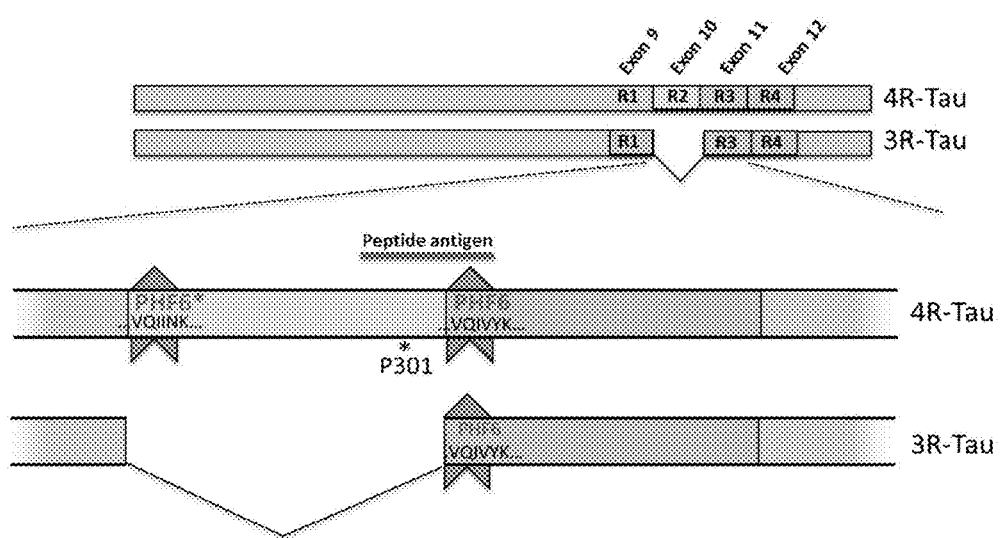
FIG. 2 illustrates the region of protein ("Peptide antigen") selected to generate the anti-Tau antibodies described herein.

To generate anti-Tau antibodies recognizing the microtubule binding region (MTBR) of Tau, the peptide sequence CNIKHVPGGGSVQIVYKPVD (SEQ ID NO: 186) (Peptide antigen) was synthesized. Residues 2-20 of SEQ ID NO: 186 correspond to the amino acid sequence that spans the juncture between the second (i.e. not present in the 3R isoform) and third repeat regions of Tau (FIG. 2). The sequence also includes the hexapeptide motif known as PHF6 (VQIVYK) (SEQ ID NO: 187) (von Bergen et al., PNAS, 2000, 97(10): 5129-5134), which is one of the sites that initiates the aggregation of Tau. Peptide antigen was coupled to the Keyhole Limpet Hemocyannin (KLH) carrier protein via the N-terminal cysteine residue that does not naturally occur in the full length Tau-441 human protein sequence. The final immunogen was prepared by mixing the Peptide antigen-conjugated KLH with Freund's complete adjuvant (1:2 (v/v)). Tau knockout mice (Jackson #007251) were immunized with 0.08 mL per mouse of a 2.5 mg/mL immunogen solution. Approximately 3 weeks following the initial injection, the mice received a boost immunization with Peptide antigen-conjugated KLH without adjuvant at 0.05 mL per mouse at the same protein concentration as before.

One month after the boost immunization, antisera were collected from the mice and antibody titers assessed by ELISA to measure immunoreactivity against the original immunizing Tau peptide and both 2N4R and 1N3R recombinant Tau proteins. Briefly, either 150 ng of Peptide antigen conjugated to BSA or 50 ng of 2N4R or 1N3R recombinant Tau protein (Enzo Life Sciences, cat. no's BML-SE321 and BML-SE323 respectively) were used to coat each well of a 96-well plate (Costar cat. no. 2797) in 10 mM phosphate buffer, pH 7.0 at 37° C. for 1 hour. Plates were blocked in a final concentration of 1% BSA diluted in PBS at room temperature for 30 minutes. Blocking solution was removed and various dilutions of anti-sera in the same blocking buffer were added to the plate for 1 hour at room temperature. The plate was washed several times with PBS prior to the addition of an HRP-labelled anti-mouse IgG antibody for 30 minutes at room temperature. Following additional wash steps, antibody binding was detected by addition of 3,3',5,5'-Tetramethylbenzidine (TMB) substrate. The enzymatic reaction was stopped with an equal volume of 2M $H_2SO_4$ and the well optical density was determined using a platereader at wavelength 450 nm.

Once mice with a high antibody titer had been determined, cells were isolated from the medial iliac lymph nodes and fused using polyethylene glycol with mouse myeloma SP2 cells to generate hybridomas. Fused cells were seeded into 96-well plates and cultured in hypoxanthine-aminopterin-thymidine (HAT) selection medium. Culture supernatants were initially screened for Tau binding using the standard peptide and recombinant Tau ELISA assays as detailed in the previous paragraph. To give an approximation of relative binding, culture supernatant that was positive in the peptide ELISA and either recombinant protein, 2N4R or 1N3R, or both, were then evaluated in a competitive ELISA system. A 96-well plate was coated with 2N4R recombinant Tau, blocked and washed as before. At the primary antibody step, culture supernatant was diluted 1 in 10 and incubated with different dilutions of free antigen (2N4R Tau) for 1 hour at room temperature before addition to the plate. Once antibody/antigen complexes were added to the plate, the protocol for the remainder of the assay was identical to the standard ELISA procedure. Single cell clones were confirmed by serial dilution and microscopy. The resulting final hybridomas were cryopreserved in serum free medium.

Antibody Purification from Hybridomas

Hybridomas were grown in Hybridoma-SFM (Life Technologies) media containing 1% FBS, 1 ng/mL human IL-6 (R&D Systems) and Penicillin/Streptomycin. Cultures were scaled up to 100 mL and supernatant was harvested when cells reached a high density and were approximately 30% viable. Antibody was purified using Protein G columns, eluted with glycine/HCl, pH2.5 and immediately neutralized. Purified antibody was then dialyzed into 25 mM sodium phosphate (pH6.5) and 150 mM NaCl, aliquoted, and stored at −80° C.

Hybridoma clones generating antibodies that recognized the original immunization peptide and full length recombinant 2N4R Tau protein were produced (Table 2).

Example 2: Affinity of Murine Antibodies to Recombinant Monomeric Tau Protein Expressed in E. coli Kinetic analysis of the interaction of the anti-Tau mouse monoclonal antibodies generated in Example 1 with human wild type Tau (2N4R) and the equivalent P301S mutant Tau protein was conducted using a BIAcore™ T100 instrument. Recombinant human full length Tau proteins were expressed in E. coli and then purified by Cellufine™ phosphate affinity chromatography followed by ammonium sulfate precipitation and reverse phase HPLC chromatography.

Purified antibodies from hybridomas were captured by protein A/G immobilized on a CM5 sensor chip (GE Healthcare). The wild type and P301S Tau proteins were then injected onto the sensor chip at five different concentrations and the affinity (equilibrium dissociation constant, $K_D$) was calculated according to the manufacturer's instruction. The results are shown in Table 2.

TABLE 2

Calculated affinity of seven anti-Tau mouse antibodies to 2N4R wild-type and P301S mutant recombinant Tau proteins.

| Antibody | Isotype | Wild type 2N4R Tau $K_D$ (nM) | P301S-2N4R Tau $K_D$ (nM) | Fold difference |
|---|---|---|---|---|
| 6B2 | IgG1, k | 1.3 | 108 | 83.1 |
| 8E5 | IgG2b, k | 0.39 | 3.35 | 8.6 |
| 4E6 | IgG1, k | 1.0 | 33.5 | 33.5 |
| 5D1 | IgG1, k | 0.9 | 10.1 | 11.2 |
| 1F1 | IgG2a, k | 0.41 | 1.42 | 3.5 |
| 5H7 | IgG2a, k | 0.61 | 3.8 | 6.2 |
| 7G6 | IgG2b, k | 0.052 | 0.57 | 11.0 |

Example 3: Fine Epitope Mapping of the ms7G6 Antibody

The recognition sequence of the murine 7G6 ("ms7G6" or "7G6") antibody against the full length wild type 2N4R human Tau protein sequence (Tau441) was fine epitope-mapped using peptide chip microarrays.

All procedures were performed by PEPperPrint GmbH, Germany. The full length 2N4R wild type human Tau sequence was elongated with a neutral GSGSGSG linker sequence (SEQ ID NO: 188) at the C-terminus and translated into overlapping 15-mer peptides. The resulting peptide microarray containing 441 different peptides was printed in duplicate onto a glass chip along with 82 spots of an additional HA-tag control peptide (YPYDVPDYAG) (SEQ ID NO: 189).

The ms7G6 anti-Tau antibody was diluted to a concentration of 1 µg/mL in PBS (pH 7.4) containing 0.05% Tween 20 and 10% Rockland blocking buffer (MB-070). The diluted antibody was incubated on the chip for 16 hours at 4° C. with shaking at 140 rpm. Primary antibody was removed and the chip was washed in PBS (pH 7.4)/0.05% Tween 20. Wash buffer was removed and goat anti-mouse IgG (H+L) DyLight™680 (1:5000) and an anti-HA tag DyLight™ 800 (1:2000) in the same buffer as the primary antibody was then incubated for 45 minutes at room temperature on the chip. Detection antibody was removed and the chip was washed once again as previously. Fluorescence images were acquired on the LI-COR Odyssey™ Imaging System and the microarray data was finally analyzed using the PepSlide™ Analyser software.

Figure 3A:
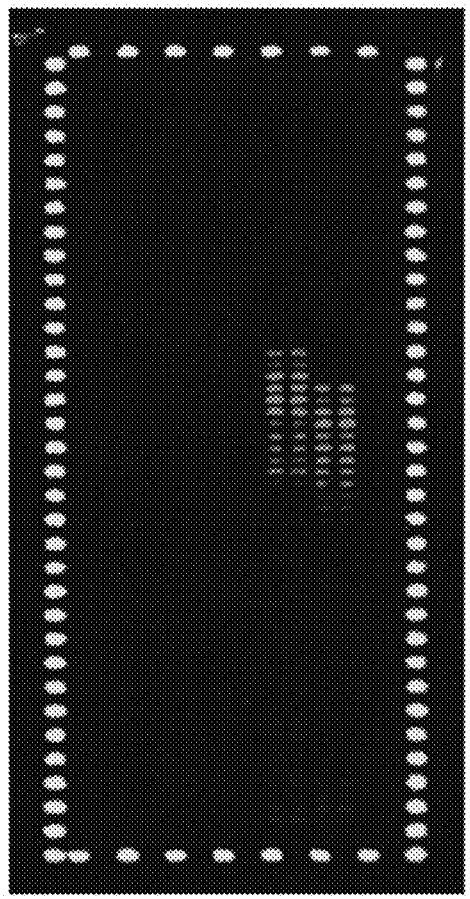
FIGS. 3A and 3B illustrate the results of the fine epitope mapping of the murine 7G6 ("ms7G6") anti-Tau antibody. For FIG. 3A, translated overlapping peptides (SEQ ID NOs: 1-37, respectively) of the wild-type 2N4R Tau sequence were synthesized and printed onto a glass chip along with a control HA-tag peptide. ms7G6 antibody binding (signal in figure interior) and the control peptide (signal on figure periphery) was detected as described in the methods.
Figure 3B:
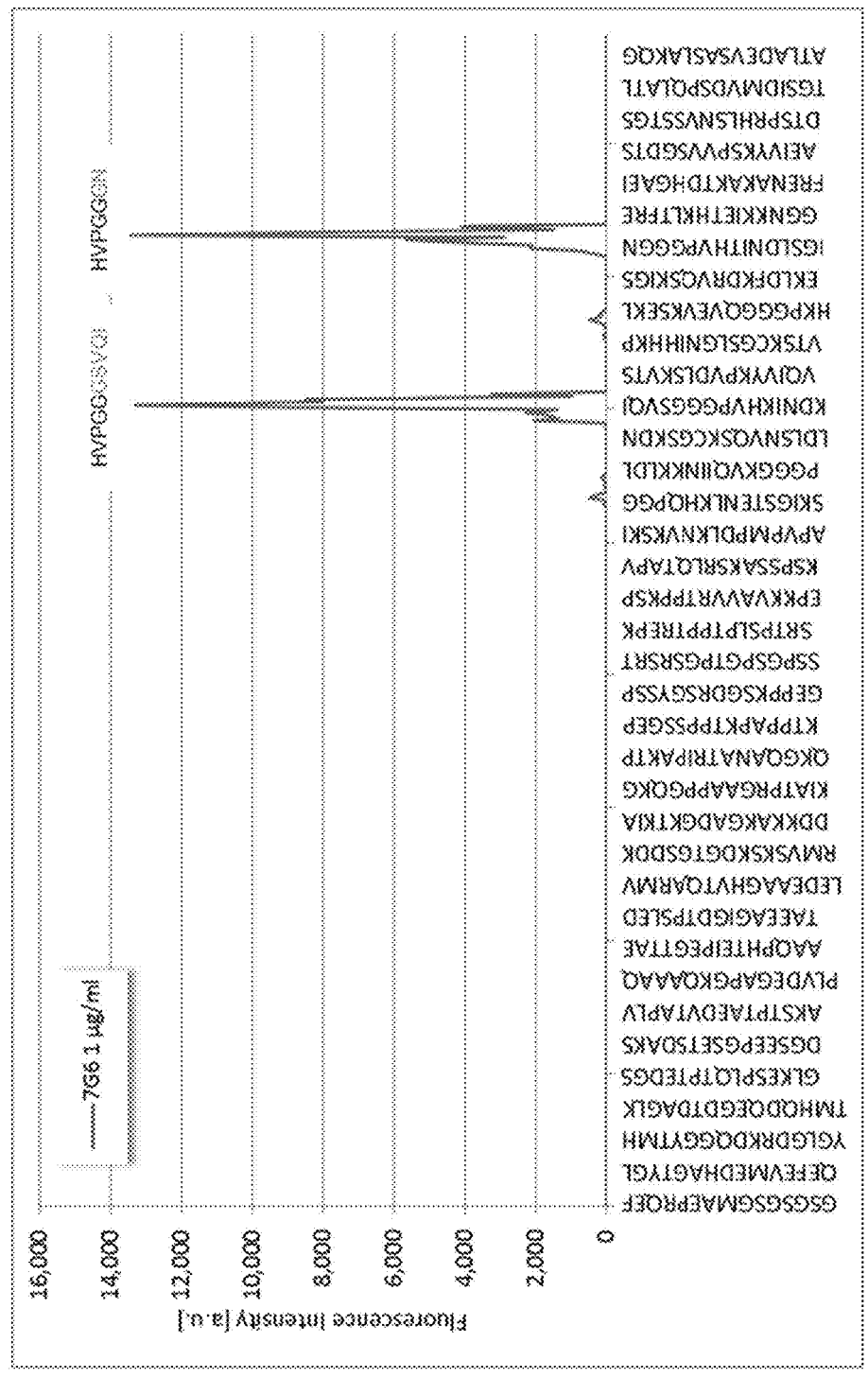

The fluorescent image of the chip (FIG. 3A) and resulting intensity plot (FIG. 3B) show that ms7G6 binds to two major sites on the full length Tau protein. It was also found that the minimum required sequence for ms7G6 binding at both sites is HVPGG (SEQ ID NO: 79) which is found at amino acid positions 299 to 303 (in the second repeat) and 362 to 366 (in the fourth repeat). Minor binding was observed at two additional sites: HQPGG (SEQ ID NO: 183) at amino acid positions 268 to 272, and HKPGG (SEQ ID NO: 182) at positions 330 to 334. Calculation of average signal intensities demonstrated that the mouse 7G6 antibody showed a 41-fold or 38-fold preference in binding to the HVPGG (SEQ ID NO: 79) site normally contained within the second repeat region of full length 4R Tau compared to the HQPGG (SEQ ID NO: 183) (repeat region 1) or HKPGG (SEQ ID NO: 182) (repeat region 3) sequences, respectively. Similarly, a 35-fold or 33-fold preference in binding to the HVPGG (SEQ ID NO: 79) site normally contained within the fourth repeat region of full length 4R Tau compared to the HQPGG (SEQ ID NO: 183) (repeat region 1) or HKPGG (SEQ ID NO: 182) (repeat region 3) sequences, respectively, was observed.

Example 4: 7G6 Epitope Substitution Scanning

To determine the amino acid stringency of the epitope recognized by the ms7G6 antibody, substitution scanning of the naturally occurring Tau peptide sequence $^1$KDNIKHVPGGGSVQI$^{15}$ (SEQ ID NO: 26) was performed. All procedures were undertaken by PEPperPrint GmbH, Germany and were based upon an exchange of all positions in the starting peptide with each of the 20 naturally-occurring amino acids.

Figure 4:
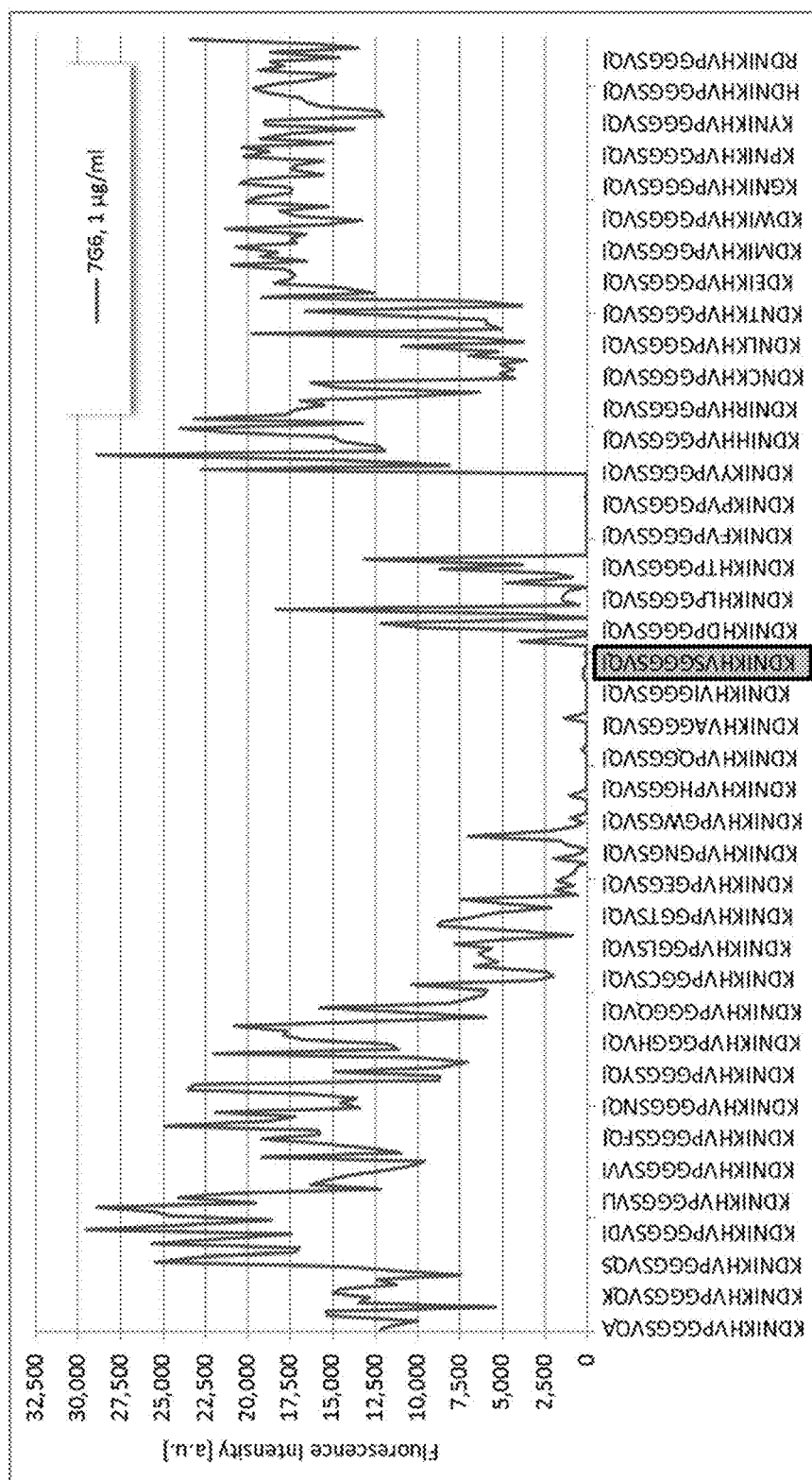
FIG. 4 illustrates the results of the murine 7G6 antibody epitope substitution scanning of the peptide sequence KDNIKHVPGGGSVQI (SEQ ID NO: 26), corresponding to amino acids 294 to 308 of the human 2N4R Tau protein. Each amino acid position of the peptide was replaced by every naturally occurring amino acid possible, printed onto a glass chip, and probed with the ms7G6 antibody.

Every possible 15-mer peptide was synthesized and printed in triplicate onto a glass chip to give a microarray containing 900 peptide spots. Additional copies of the wild type peptide as well as the HA-tag control peptide were also spotted onto the chip as controls. The peptide chip was then probed with ms7G6 under the same conditions as described in Example 3 (Fine epitope mapping of the ms7G6 antibody) and the resulting data analyzed using the PepSlide™ Analyser software (FIG. 4 illustrating results with SEQ ID NOs: 38 to 78). The substitution scanning showed that, within the peptide epitope of $^1$HVPGG$^5$ (SEQ ID NO: 79), antibody ms7G6 shows some flexibility in the second position with a number of possible residues. There is also some binding when the 5$^{th}$ amino acid (glycine) is substituted to either an alanine or serine. The middle proline residue is needed for antibody binding and may not be substituted with any other naturally-occurring amino acid. This amino acid can correspond to the P301 residue (within amino acids 299 to 303 of Tau441, Uniprot accession number P10636-8) which is commonly mutated to a serine or leucine residue to mimic human Tauopathy in a number of preclinical in vitro and in vivo models. The substitution scanning data indicates that the ms7G6 antibody preferentially recognizes the amino acid sequence HVPGG (SEQ ID NO: 79) binding site at amino acids 362-366 in the mutant P301S protein.

Example 5: In Vitro Tau Aggregation

To determine whether the ms7G6 antibody could functionally inhibit Tau aggregation in vitro, aggregation assays were performed with recombinant Tau protein.

Wild type or P301S mutant Tau protein was diluted to a concentration of 60 µM in buffer containing 25 mM HEPES (pH 7.4), 100 mM NaCl and 0.5 mM TCEP in a final volume of 20 µl. The mixture was heated in a thermal cycler at 98° C. for 30 minutes and then allowed to cool to room temperature. Mouse IgG2b control or ms7G6 antibodies were diluted to a final concentration of 8.3 µM in 25 mM HEPES (pH7.4), 100 mM NaCl and HALT Protease and Phosphatase inhibitors. Diluted antibodies or buffer controls were mixed with the Tau proteins and incubated at 37° C. for 30 minutes. To induce Tau aggregation, heparin was added to each reaction to a 12 µM final concentration in a final volume of 100 µl. The final reaction conditions were 12 µM Tau, 8.3 µM antibody, 0.1 mM TCEP and 12 µM Heparin in 25 mM HEPES pH7.4/100 mM NaCl buffer. The final reaction mixtures were incubated at 37° C. for at least 6 days with sampling throughout to measure Tau aggregation.

The aggregation of Tau was measured on days 0, 1, 2, 5 and 6 by removing 10 µL of the reaction mixture and placing into a 384-well, black-bottomed plate (Greiner). Thioflavin S dye was added to each well to a final concentration of 15 µM, and the plate was incubated at room temperature in the dark for 30 minutes. Fluorescence was measured on a Pherastar™ platereader with excitation and emission wavelengths at 485 nm and 520 nm, respectively.

Figure 5A:
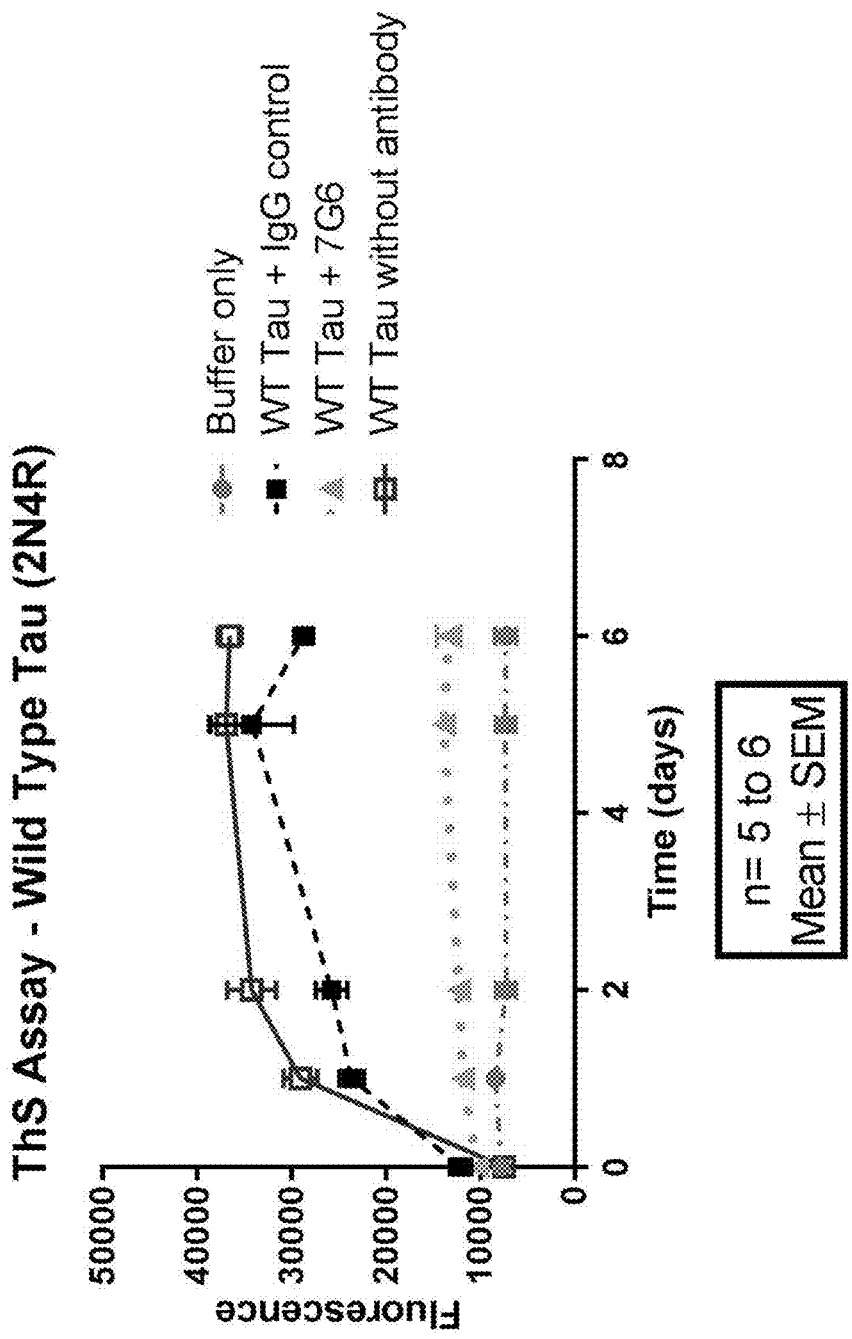
FIGS. 5A and 5B illustrate the degree and rate of heparin-induced aggregation for the wild-type and P301S Tau proteins, respectively, in the presence and absence of ms7G6 ("7G6") anti-Tau antibody. Mouse IgG that is unable to bind Tau was included as a control antibody.
Figure 5B:
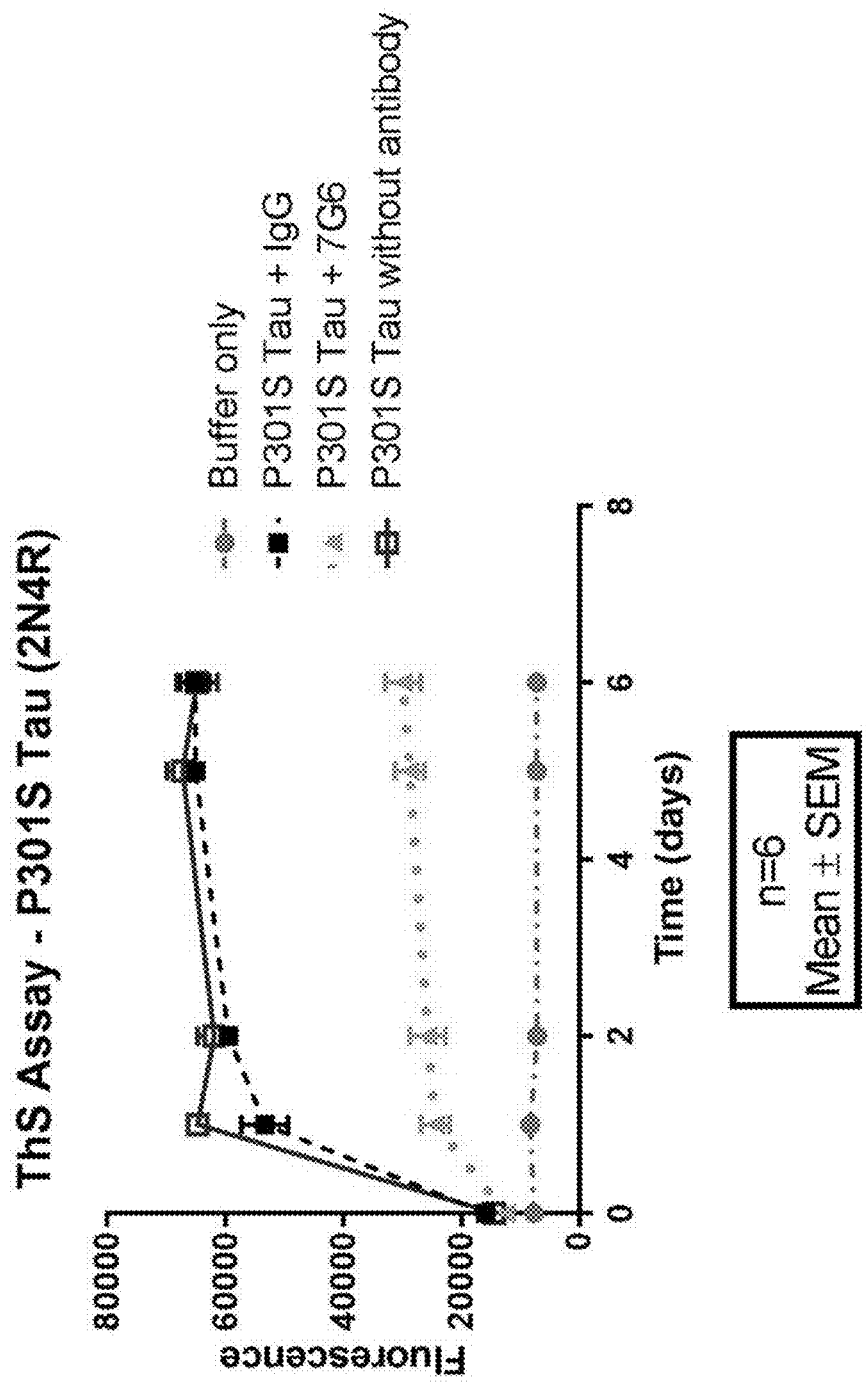
Figure 6A:
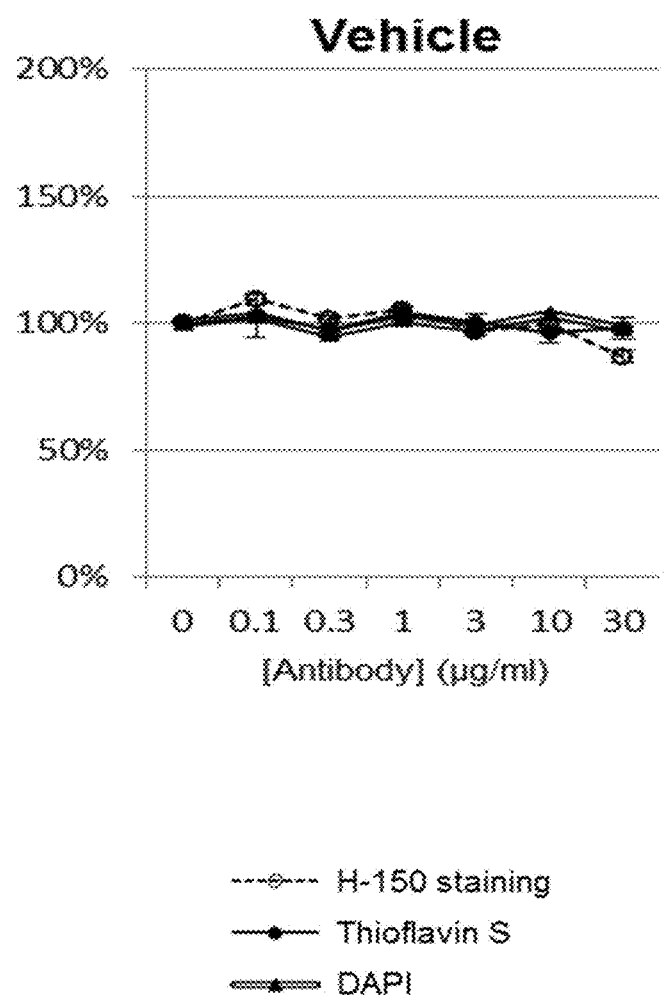
FIGS. 6A, 6B, 6C, and 6D illustrate the effects of vehicle control, human IgG1k, murine 7G6 anti-Tau antibody, and humanized 7G6-HCzu25-LCzu18 antibody, respectively, in an in vitro cell-based model of Tau seeding and aggregation.
Figure 6B:
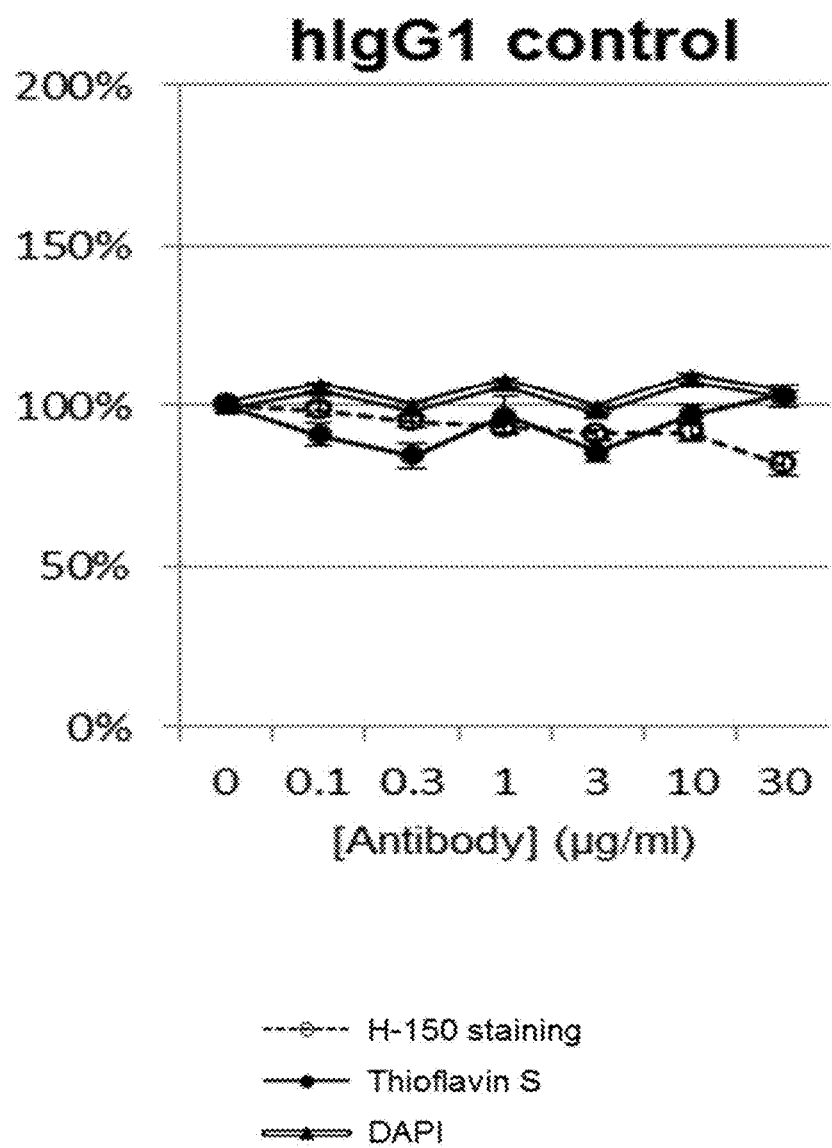
Figure 6C:
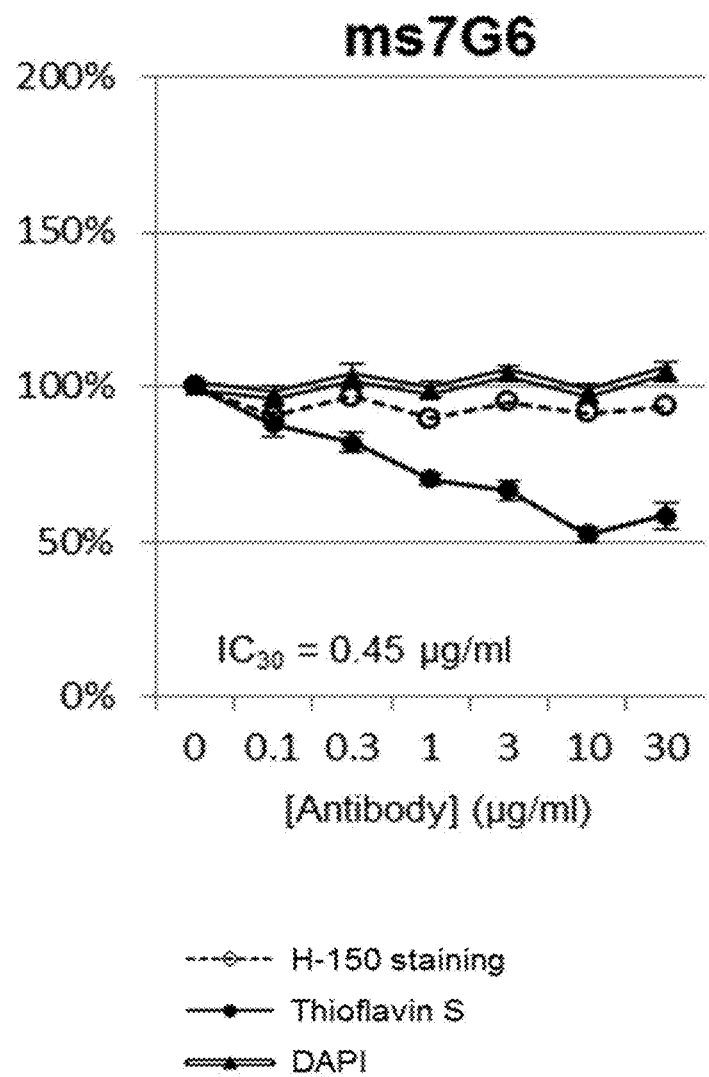
Figure 6D:
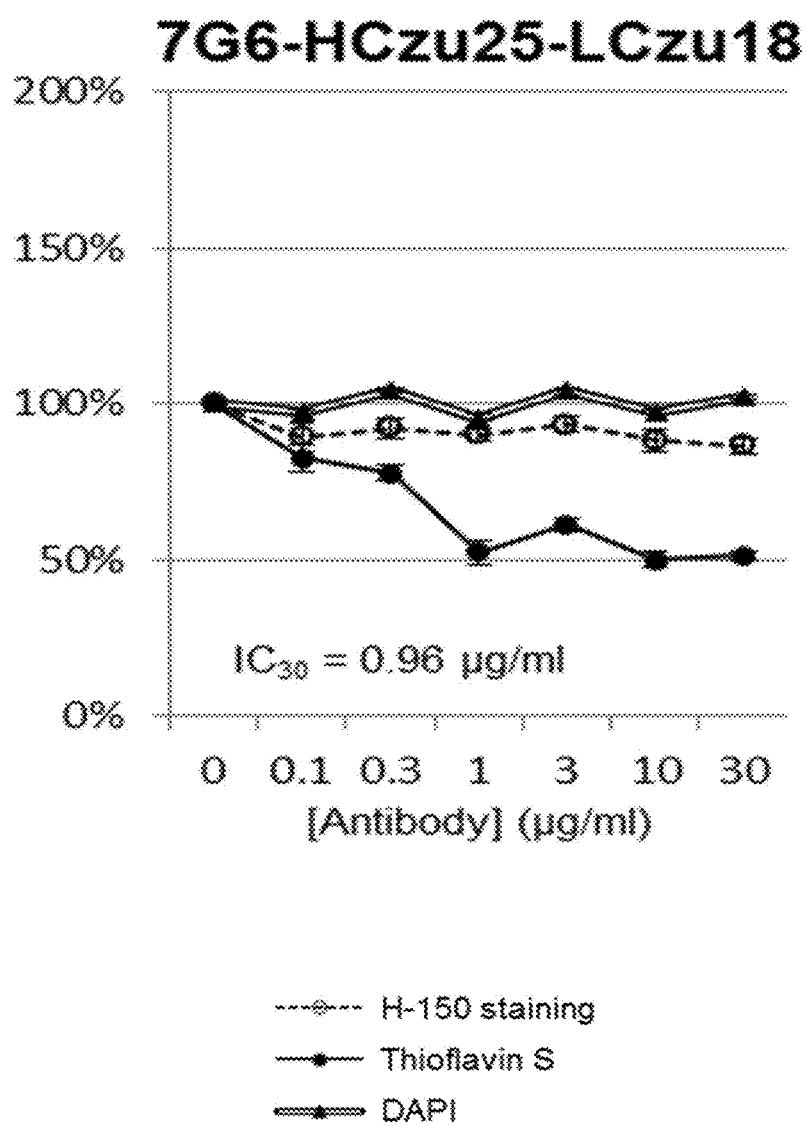

As shown in FIGS. 5A and 5B, the degree and rate of heparin-induced aggregation was higher for the P301S Tau protein compared to the wild type. The ms7G6 antibody substantially reduced the aggregation of both P301S Tau and wild-type Tau in vitro compared to IgG, as indicated by the lower amount of fluorescence generated. This suggests that, even for the P301S protein, ms7G6 binding to residues 362-366 alone could inhibit aggregation under these conditions.

Example 6: In Vitro Cell Seeding Model

To determine whether ms7G6 or a humanized version known as 7G6-zuHC25-zuLC18 (see Example 10) had an effect on cells, each antibody was tested in an in vitro cell-based model of Tau seeding and aggregation.

The 2N4R isoform of human wild type Tau was expressed in *E. coli* and then purified as previously described (Soeda et al., *Nat Commun.* 2015, 6: 10216). Recombinant Tau (40 µM) was mixed with heparin (240 µg/mL) and incubated at 37° C. for 48 to 96 hours in 100 mM sodium acetate, pH 7.0, containing 2 mM DTT. Aggregated Tau protein was collected by ultracentrifugation and resuspended in 100 mM sodium acetate pH 7.0 or PBS. The solution was then sonicated to produce the recombinant Tau seeds.

Neuro-2a (ATCC) cells were transfected in suspension with cDNA expression plasmids encoding 0N4R P301S Tau using Lipofectamine LTX (Thermo Fisher Scientific) and plated at a density of 1.5×10$^4$ cells per well into a 96-well plate in DMEM medium containing 10% fetal bovine serum. Cells were left to attach overnight at 37° C. prior to adding Tau seeds. In parallel, various concentrations of anti-Tau antibodies were mixed with 1 µg/mL of Tau seed and were also incubated overnight at 37° C. The following day, culture medium was removed and medium containing the mixture of anti-Tau antibodies and seed were added. Plates were cultured again overnight at 37° C.

Cells were fixed with a final concentration of 4% paraformaldehyde and immunostained by H-150 (Santa Cruz Technology, sc-5587), thioflavin S (Sigma-Aldrich, T-1892) and DAPI (Wako, 340-07971). Images were captured and analysed using the InCell Analyzer 2200 and Toolbox.

As shown in FIGS. 6A, 6B, 6C, and 6D, a significant decrease in Thioflavin S staining (aggregated Tau) was observed in response to both ms7G6 and 7G6-HCzu25-LCzu18 treatment. This indicates that both antibodies were able to block the Tau seeding effect in this cell-based model under these assay conditions.

Example 7: Efficacy in a Preclinical In Vivo Model of Tauopathy by Pre-Incubating Recombinant P301S Tau Seeds with Antibodies The effects of three new antibodies, including ms7G6, were tested in a short term in vivo model of Tau deposition by pre-incubating the relevant antibodies with recombinant P301S Tau seeds. The seeds with or without antibody were then injected into the brains of P301S transgenic mice.

Intracerebroventricular (ICV) Injection of Tau Seeds

Pre-formed fibrillar (PFF) Tau was generated by mixing recombinant 2N4R P301S Tau (40 µM) and heparin (240 µg/mL), followed by an incubation step at 37° C. for 48 to 96 hours in 100 mM sodium acetate, pH7.0, containing 2 mM DTT. Aggregated Tau was collected by ultracentrifugation and resuspended in 100 mM sodium acetate, pH7.0. The resulting fibrils were sonicated and used as seeds for injection. Tau seeds at a concentration of 0.83 mg/mL were incubated with 1 mg/mL IgG$_1$ or 2 mg/mL anti-Tau antibody for 1 hour at 37° C. The Tau seeds/antibody mixtures, controls (i.e., Tau alone) or vehicle was injected into the intracerebroventricular (ICV) zone of 2-3.5 months old P301S transgenic mice (MRC Technology, United Kingdom). These mice overexpress human 0N4R P301S Tau under the control of the murine neuron-specific Thy-1 promoter on a CBAxC57/b16 background.

It has been reported previously that these animals, if untreated, develop widespread Tau pathology in the brain and spinal cord with significant motor deficits at 5 to 6 months of age (Allen et al., *J Neurosci.* 2002, 22(21):9340-51). In the current experiment using younger P301S mice, animals were sacrificed two weeks after the ICV injection, brains were removed, and the tissue region of interest collected. Tissue samples were then fractionated into sarkosyl-soluble and insoluble Tau (Sahara et al., *J Neurochem.* 2002 December; 83(6):1498-508) as described below.

Extraction of Sarkosyl-Insoluble Tau from Seed-Injected P301S Mouse Brain

Tissue was homogenized in 19 volumes (tissue weight/volume) of extraction buffer containing 50 mM Tris-HCl (pH7.5) (Invitrogen), 5 mM EDTA (Nippon Gene), 1 mM EGTA (Nacalai Tesque), 1% NP-40 (Fluka), 0.25% deoxycholic acid sodium salt (Sigma Aldrich), 0.1 M NaCl, 0.5 mM PMSF (Sigma Aldrich), 1× PhosSTOP™ (Roche, Basel, Schweiz), and 1× Complete EDTA(−) (Roche). Homogenates were centrifuged at 163,000 g at 4° C. for 20 minutes and the resulting supernatants were collected and retained as the Tris buffer-soluble fraction. The pellet was resuspended in about 10 volumes (tissue weight/volume) of buffer containing 10 mM Tris-HCl (pH7.5), 0.5 M NaCl, 1 mM EGTA, 10% sucrose (Wako Pure Chemical), and 1% sarkosyl prior to sonication. Sarkosyl-treated samples were incubated at 37° C. for 60 minutes, and then centrifuged at 163,000 g at 4° C. for a further 20 minutes. The supernatants were collected as the sarkosyl-soluble fraction. Finally, about 10 volumes of PBS (Gibco) was added to the pellet which was then sonicated. This formed the sarkosyl-insoluble fraction.

Detection of Sarkosyl-Insoluble Tau by Western Blotting

Sarkosyl-insoluble fractions were solubilized in NuPAGE™ LDS sample buffer and NuPAGE™ sample reducing agent (Invitrogen), heated at 70° C. for 10 minutes, and separated using 12.5% polyacrylamide gels (DRC). Proteins were transferred to 0.2 μm PVDF membranes (Bio-Rad, Hercules, Calif., USA) and blots were blocked in 2.5% skimmed milk (Yukikirushi) in TBS (Takara) containing 0.05% Tween (Nacalai tesque) for 1 hour at room temperature. After blocking, blots were probed with the human-specific monoclonal anti-Tau antibody HT7 (1:1000 or 1:2000, Thermo Fisher Scientific, Waltham, Mass., USA) in blocking buffer for 1 hour at room temperature. The blots were washed in TBS-T for 30 minutes and then incubated with HRP-conjugated anti-mouse IgG (1:2000, GE healthcare) for a further 1 hour at room temperature. Secondary antibody was removed and blots were washed as described above. Tau proteins were detected by chemiluminescent horseradish peroxidase (HRP) substrate (Merck Millipore) and quantified using the Fusion FX (Vilber-Lourmat, France) analyzer. To determine the amount of Tau, serial dilutions of standards Tau derived from the originating sarkosyl-insoluble fraction of P301S spinal cord were loaded onto each gel.

Figure 7:
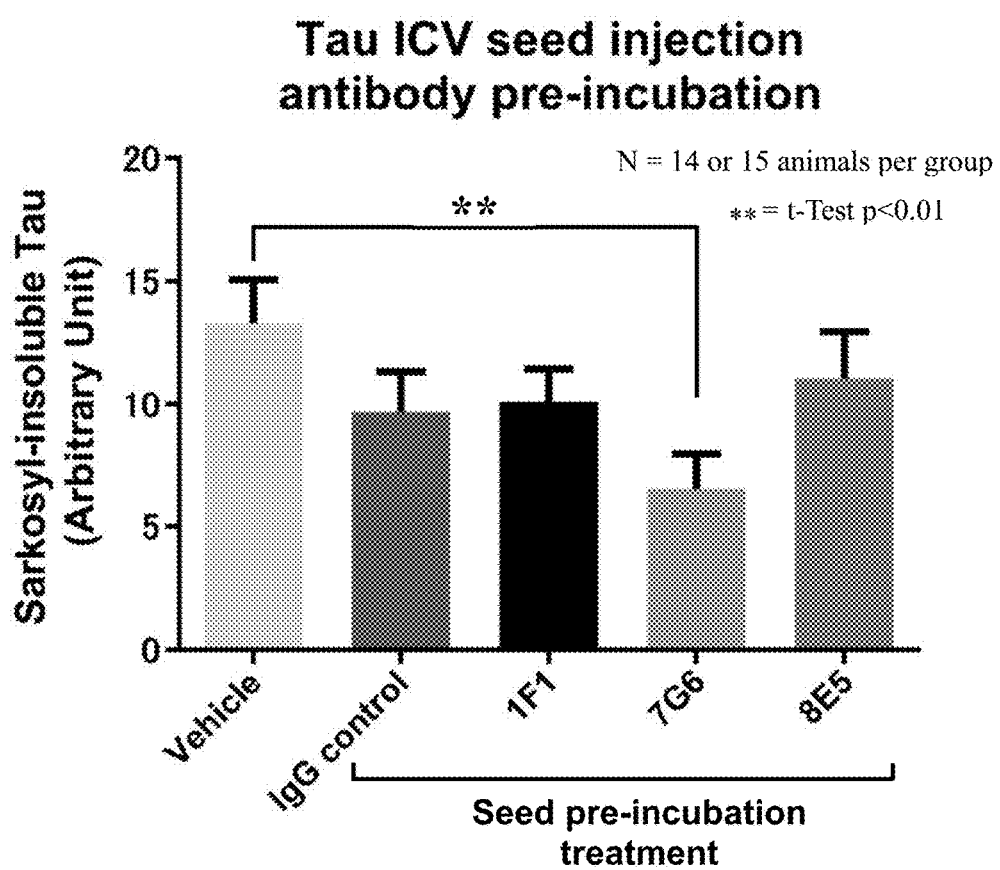
FIG. 7 illustrates the results of pre-incubation of recombinant human P301S Tau seeds with either vehicle, mouse IgG control antibody, and murine anti-Tau antibodies 1F1, 7G6, or 8E5 in a preclinical in vivo Tau seeding model.

As shown in FIG. 7, pre-incubation of P301S seeds with ms7G6 but not control IgG, 8E5 or 1F1 showed a significant decrease in sarkosyl-insoluble Tau levels compared with vehicle. This suggested that ms7G6 was a superior antibody in this paradigm compared to the other anti-Tau antibodies generated.

Example 8: Validation of the P301S Seeding and Transmission In Vivo Model

To determine whether any transmission from one brain region to another of pathological Tau could occur in a rodent preclinical model, the same seeding experiment was performed in P301S transgenic mice as described in Example 7 but with some modifications. In this case, 20 μL of recombinant P301S Tau seeds at a concentration of 0.9 mg/mL was injected ICV into the brains of 2.5 to 3 month old mice. Mice were sacrificed at either 2, 4 or 6 weeks following the initial seed injection, brains were removed and both hippocampus and cortex were retained. The sarkosyl-insoluble Tau was prepared and detected as described above.

Figure 8:
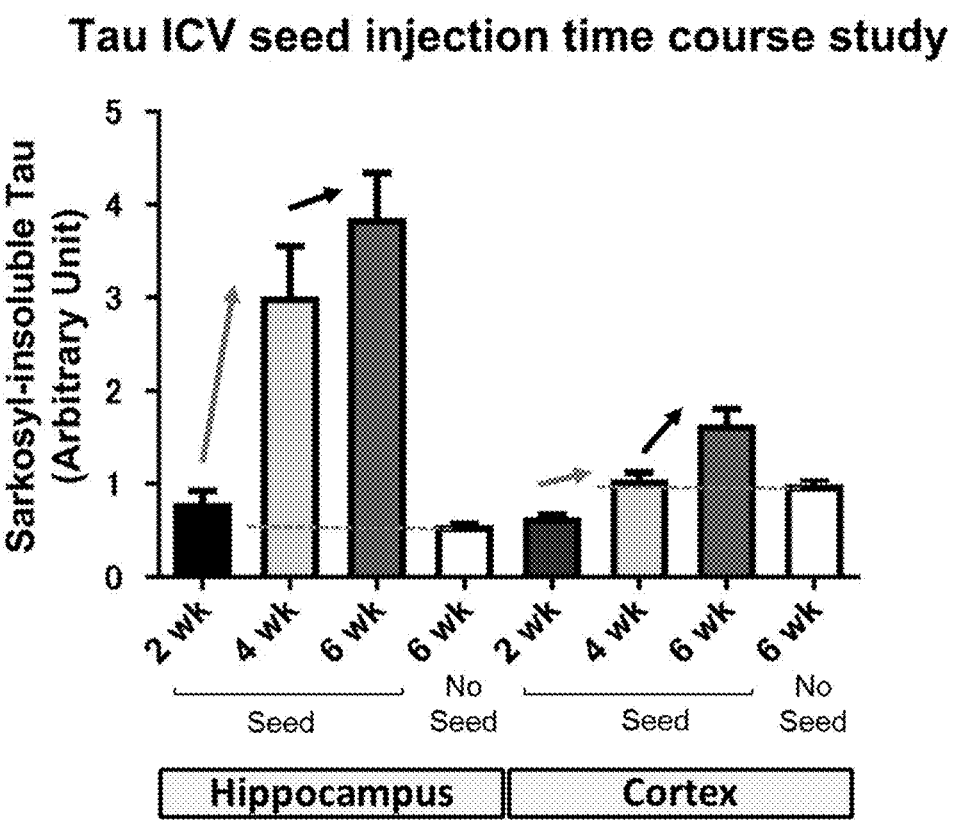
FIG. 8 illustrates the time course of insoluble Tau development in the hippocampus and cortex of P301S transgenic mice that were ICV-injected with recombinant P301S Tau seeds.

As shown in FIG. 8, a sharp increase in insoluble Tau levels was observed in the hippocampus between 2 and 4 weeks post seed-injection but only low levels of insoluble Tau was observed in the cortex at the same time point. However, between 4 and 6 weeks following seed injection a greater increase of insoluble Tau was observed in the cortex compared with the no-seed control group. This shows that, in this model, insoluble Tau can form in the hippocampus, prior to the cortex, suggestive of a secondary transmission event.

Example 9: Effect of Peripheral Once Weekly Dosing of 7G6 in the P301S Seed Injection in Vivo Model a) Experiment 1

The P301S Tau seed injection into P301S transgenic mice was performed as described in Example 8 with minor modifications. About seven to about four hours prior to Tau seed injection, mice received a dose of either 40 mg/kg IgG2b control antibody (BioXCell) or ms7G6 antibody intraperitoneally. Each antibody was formulated in 25 mM phosphate buffer (pH6.5) with 150 mM NaCl. A vehicle treatment control group was also included which received buffer alone. Following Tau seed injection into the brain, mice received further doses of antibody or buffer once weekly for a period of 6 weeks. Animals were then sacrificed, brain tissues isolated, and insoluble Tau was prepared and measured as described in Example 7.

b) Experiment 2

An exact repeat of Experiment 1 (Example 9a) was performed.

c) Experiment 3

A repeat of Experiment 1 (Example 9a) was performed again except two dosing levels of ms7G6, 20 and 40 mg/kg, were administered and the animals were sacrificed 8 weeks after seed injection rather than 6 weeks as in the previous two experiments.

Figure 9:
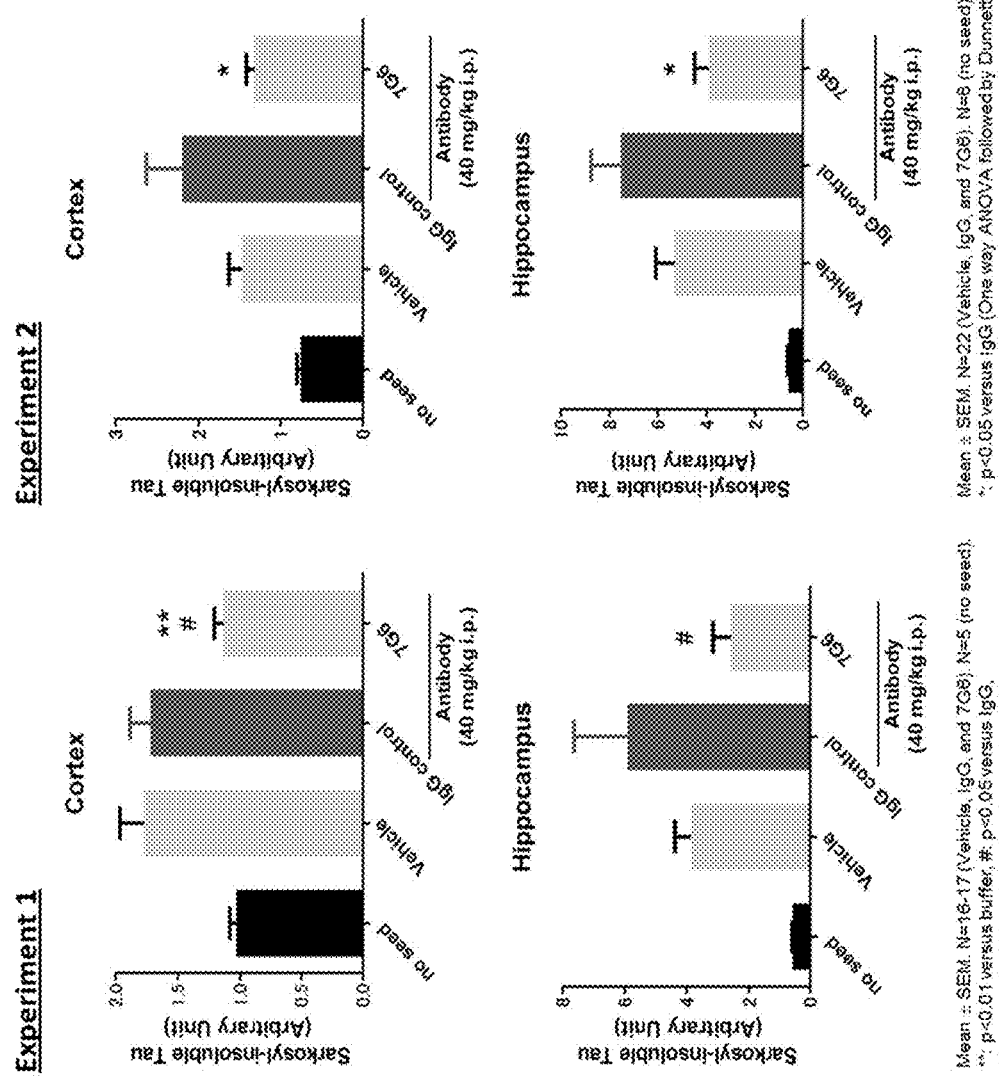
FIG. 9 illustrates the effect of peripheral, single repeat dosing of ms7G6 antibody in the P301S in vivo seeding model. ms7G6 caused a reduction in insoluble Tau levels in hippocampus and cortex.
Figure 10:
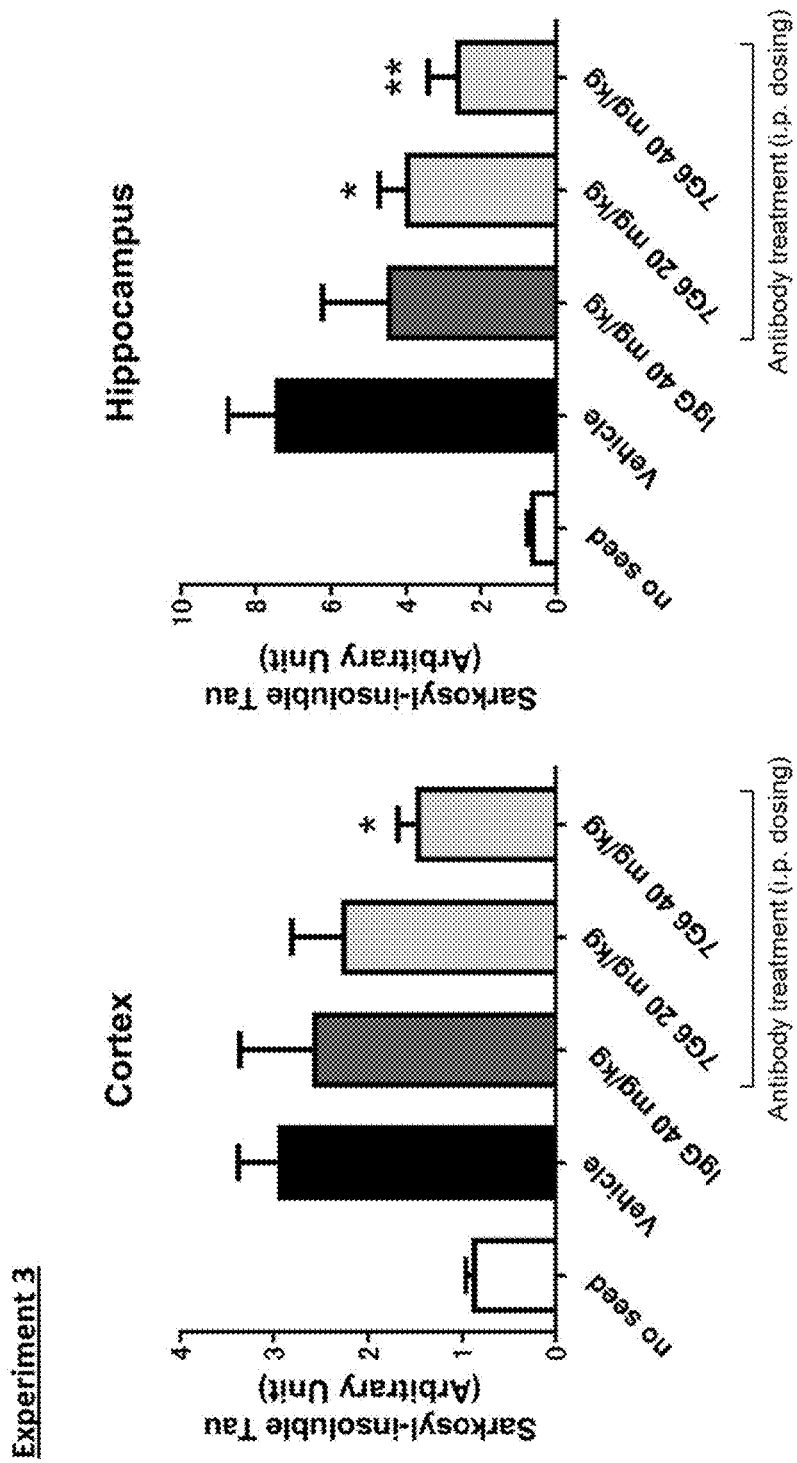
FIG. 10 illustrates the effect of peripheral multiple repeat dosing of ms7G6 anitbody in the P301S in vivo seeding model. Reduction of insoluble Tau levels by antibody 7G6 was dose-dependent.
Figure 13A:
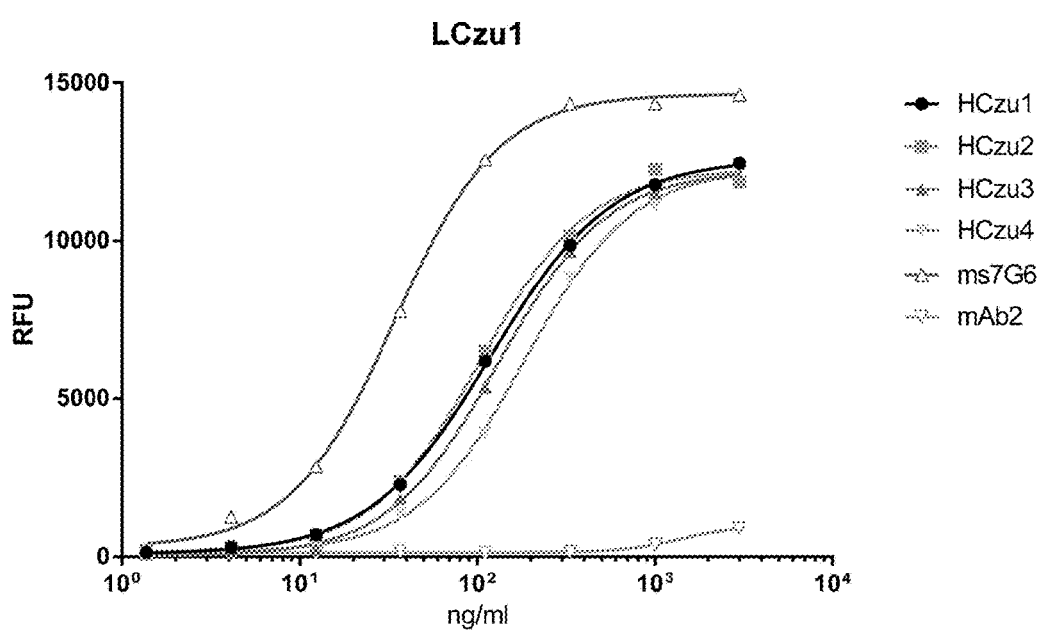
FIGS. 13A, 13B, 13C, 13D, 13E, and 13F illustrate Tau binding by ELISA with 7G6 LCzu1 humanized variants (FIG. 13A), 7G6 LCzu2 humanized variants (FIG. 13B), 7G6 LCzu3 humanized variants (FIG. 13C), 7G6 LCzu4 humanized variants (FIG. 13D), 7G6 LCzu5 humanized variants (FIG. 13E), and 7G6 humanized variants with Ser substituted for Cys49 (according to Kabat) on the light chain and Cys57 (according to Kabat) on the heavy chain (FIG. 13F).
Figure 13B:
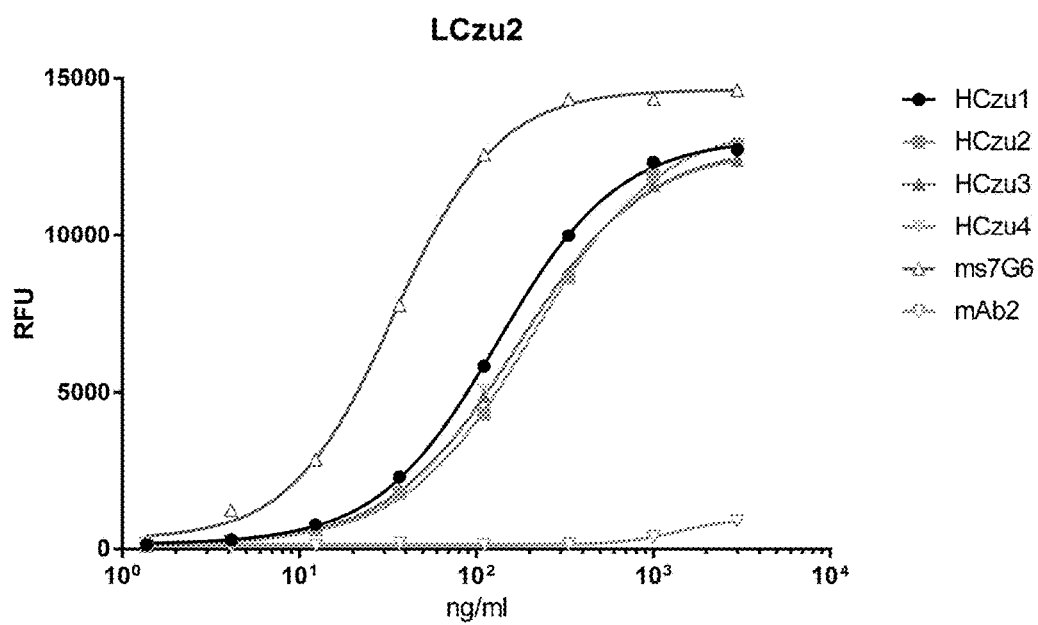
Figure 13C:
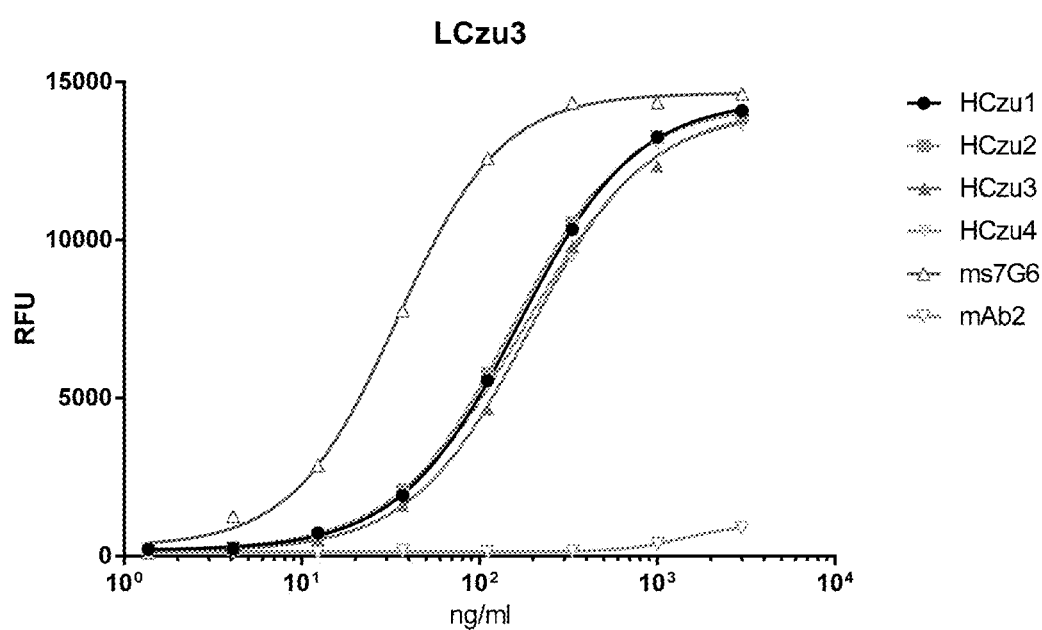
Figure 13D:
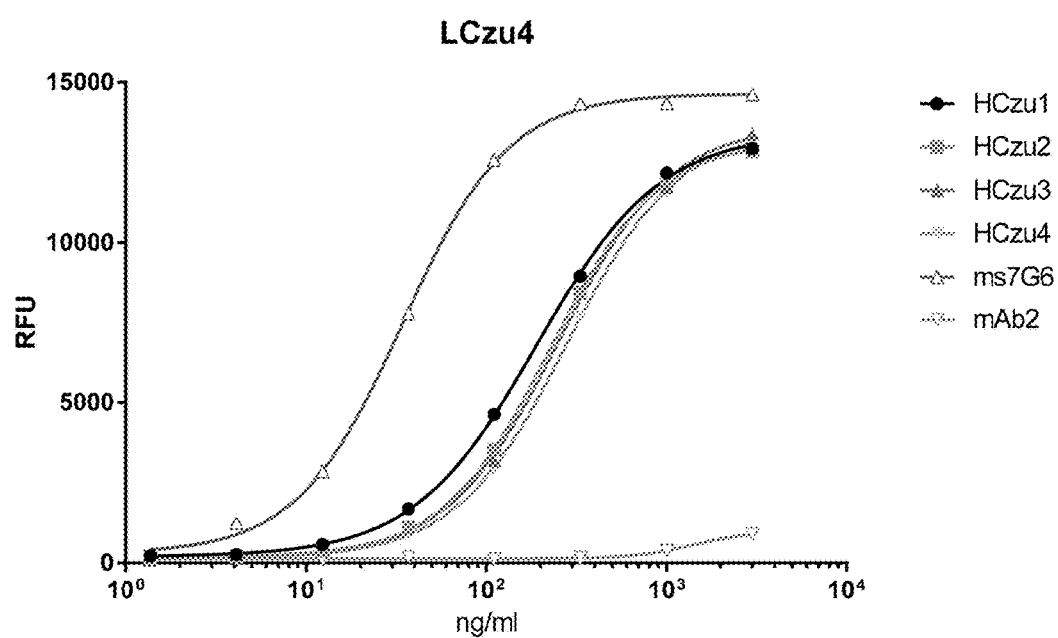
Figure 13E:
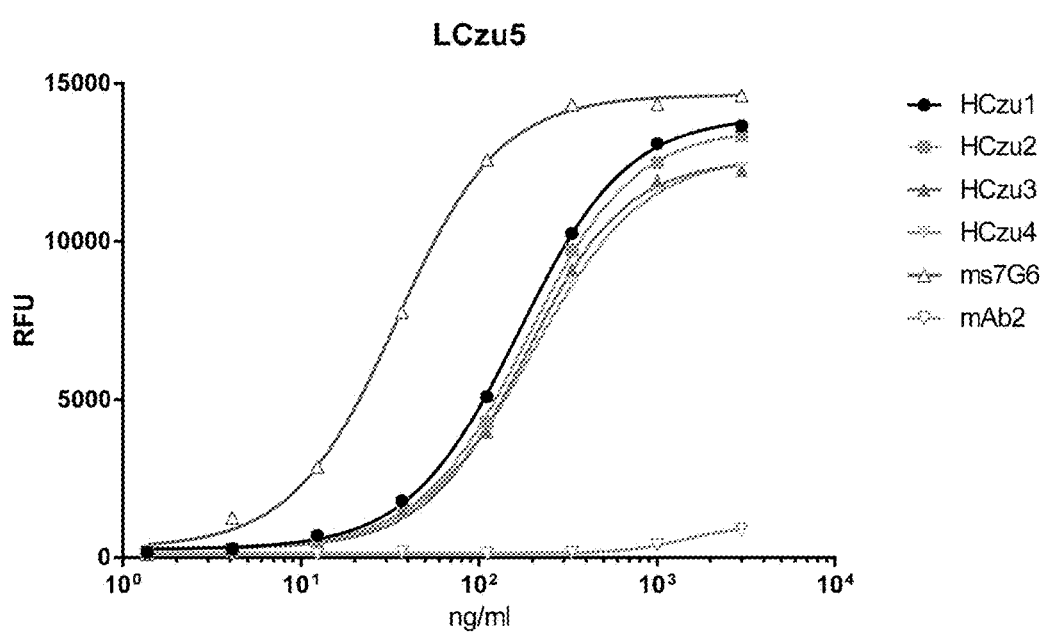
Figure 13F:
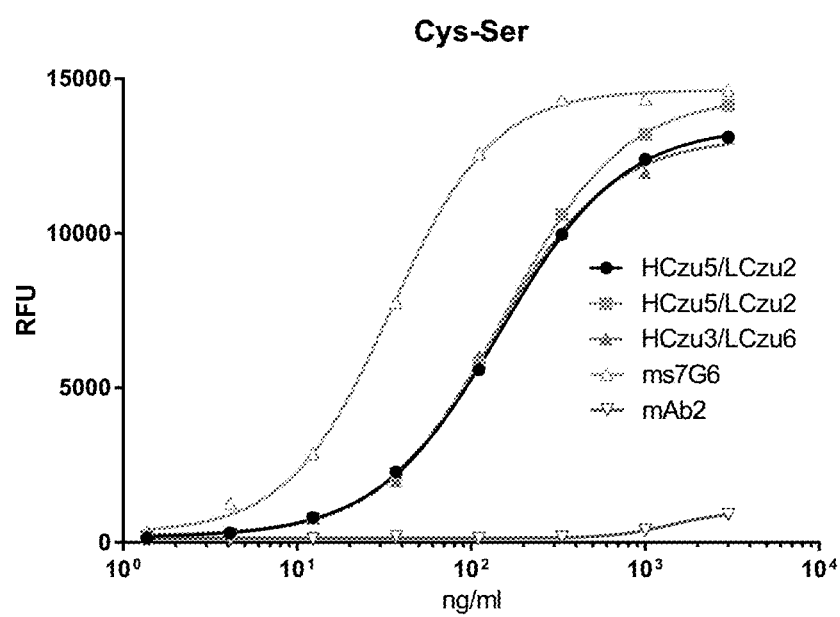

As shown in FIGS. 9 and 10, these three experiments demonstrate that ms7G6 can cause a reduction in insoluble Tau levels in this seed injection model with P301S recombinant Tau seeds in a P301S transgenic mouse. The reduction observed in the cortex suggests that the antibody may slow pathological Tau transmission. It was ascertained in example 4 that the ms7G6 antibody is unable to bind to the HVSGG sequence (SEQ ID NO: 184) (aa299-303) that is present in the P301S site of the mutant protein. Taken together, this means that the in vivo effects of ms7G6 in this in vivo model are driven by the binding to Tau at the remaining HVPGG (SEQ ID NO: 79) epitope within the fourth repeat region (aa362-366).

Example 10: Antibody Humanization

10A. Materials & Methods 10A.a. In Silico Modeling

Discovery Studio 4.5 was used to generate a molecular model of the ms7G6 Fv region. The top 1 to 3 crystal structures with the most homologous protein sequences to the ms7G6 variable heavy (VH) and variable kappa (VK) domains were used as a template for generating twenty-five homology models using the "Create Homology Models" function. The model with the lowest energy score was selected and the energy was first minimized for just the hydrogens and then for all atoms. Framework residues differing between the mouse sequences (HCzu1 and LCzu1) were highlighted and those closest to the CDRs or at the VH/VK interface were identified as residues that may be important for maintaining Tau binding by the CDRs or for antibody stability, respectively. CDR residues differing between the mouse sequences (HCzu1 and LCzu1) were highlighted and residues were identified that may be not important for maintaining Tau binding by the CDRs.

10A.b. Gene Synthesis and Cloning 10A.b.1. InFusion™ Cloning

Humanized heavy and light variable domains were codon-optimized for expression in CHO cells and were synthesized by GeneArt. The variable domains were synthesized with a Kozak translation initiation sequence and an Ig secretion leader sequence and included 15 base-pairs at the 5' and 3' ends homologous to the cloning site within the subcloning vector. PCR fragments synthesized by GeneArt were subcloned into an expression plasmid containing a human gamma or kappa constant region using an InFusion™ HD cloning kit (Clontech). All clones were sequenced to confirm the presence and fidelity of the inserts.

10A.b.2. QuikChange™

Point mutations were made using Stratagene's QuikChange™ XL according to the manufacturer's protocol. All clones were sequenced to confirm the presence of the mutation.

10A.c. Cell Culture 10A.c.1. HEK Transient mAb Production

For each milliliter of $3 \times 10^6$ cells to be transfected with ExpiFectamine™ (Thermo), 333.3 ng HC plasmid and 333.3 ng LC plasmid were incubated for 5-10 min in 50 µL Opti-MEM (Thermo). Likewise, 2.67 µL ExpiFectamine™ was incubated in 50 µL Opti-MEM. The ExpiFectamine™ solution was added to the DNA mixture and incubated for 20-30 min at room temperature. The DNA:ExpiFectamine™ mixture was added to the cells while swirling and incubated at 37° C., 8% $CO_2$, shaking at 125 rpm. The following day, 5 µL of enhancer 1 and 50 µL of enhancer 2 per mL of cells were added to the transfection with continued incubation for another 7-10 days. After 48-72 h, cells were fed at a final concentration of 10 g/L Yeastolate (BD Biosciences), 5 mM valeric acid (Sigma-Aldrich), and 1:100 CD Lipid Concentrate (Thermo).

10A.c.2. CHO Transient mAb Production

For each milliliter of $6 \times 10^6$ cells to be transfected with ExpiFectamine™ CHO (Thermo), 500 ng HC plasmid and 500 ng LC plasmid was mixed in Opti-PRO™ (Thermo) in 40 µL total volume. Likewise, 3.2 µL ExpiFectamine™ CHO was mixed in 36.8 µL Opti-PRO. The ExpiFectamine™ CHO solution was added to the DNA mixture and incubated for 1-5 min at room temperature. The DNA:ExpiFectamine™ CHO mixture was added to the cells while swirling and incubated at 37° C., 8% $CO_2$, shaking at 125 rpm. The following day, 6 µL of enhancer and 160 µL of feed per mL of cells were added to the transfection, and cells were transferred to 32° C., 5% $CO_2$. At day 5, an additional 160 µL of feed per mL of cells was added. At day 12 to 14, the supernatants were harvested.

10A.d. MAb Purification 10A.d.1. Batch Purification

Prosep™-vA High Capacity Protein A resin (Millipore) or CaptureSelect™ KappaSelect LC-kappa resin (Thermo) was equilibrated with DPBS, and 50 µL were added to 2 mL of sample. Following incubation at room temperature for 1 hour, the medium and resin were added to a filter plate and washed twice with 1 mL DPBS. The sample was eluted from the resin by addition of 400 µL 0.1 M Glycine, pH 2.9 followed by centrifugation at 15,000×g for 30 s. The sample was neutralized with 20 µL of 1 M Tris, pH 8.0. The samples were concentrated to 100 µL by centrifugation at 15,000×g for 5 minutes using 0.5 mL Amicon™ Ultra, 10 k cutoff filters (Millipore) and were buffer-exchanged into DPBS using 0.5 mL Zeba™ desalting columns, 7K MWCO, according to the manufacturer's protocol.

10A.d.2. Column Purification

Purification was performed using an AKTA Xpress purification platform (GE Healthcare). Up to 1 L conditioned medium was loaded onto a 5 mL MabSelect™ SURE column (GE Healthcare) equilibrated in 20 mM sodium phosphate, 150 mM NaCl, pH 7.0. The column was washed extensively with equilibration buffer following loading until a stable baseline was observed. Bound material was eluted using 100 mM glycine, pH 2.9. Eluted material was immediately injected on to a 26/10 HiPrep desalting column (GE Healthcare) equilibrated in 1× phosphate-buffered saline (PBS) and eluted in the same buffer. Peak fractions were pooled. The material was analyzed for protein content by BCA assay (Thermo) and purity by reducing and non-reducing SDS-PAGE.

10A.e. 2N4R Tau-Binding ELISA

A black Nunc MaxiSorp 96-well plate was coated with 2 µg/mL (unless otherwise indicated) of recombinant wild-type 2N4R Tau in DPBS overnight at 4° C. The following day the plate was aspirated and washed three times with Wash Buffer (PBS+0.05% Tween-20). The wells were incubated with Assay Buffer (1% w/v BSA [heat shock fraction, Sigma], 0.05% Tween-20 [BioRad], DPBS) for 1 h at room temperature. The Assay Buffer was aspirated and the wells were washed three times as above. Various concentrations of mAbs in DPBS were added to each well for 1 hour at room temperature while shaking on a microtiter plate shaker. Samples were aspirated and the wells were washed three times as above. HRP-conjugated goat anti-mouse IgG (H+L) (JIRL 115-035-146), gt anti-hu IgG (H+L) (JIRL 109-035-127), or Streptavidin-HRP (JIRL 016-030-084) was diluted 1:5000 in Assay Buffer and added to the wells. Following incubation and shaking at room temperature for 1 hour, samples were aspirated and the wells were washed three times as above. QuantaBlu (Thermo) was added to each well and incubated for 15 min at room temperature. The relative fluorescence units (RFU) were measured with the excitation and emission wavelengths set at 320 and 460 nm, respectively, using a Spectramax™ M5 plate reader (Molecular Devices).

10A.f. Surface Plasmon Resonance (SPR) Binding Analyses 10A.f.1. Anti-Human/Anti-Mouse Capture Monomeric Tau-Binding Assay 10A.f.1.i. Chip Preparation All experiments were performed using a BIAcore™ T-100 instrument (GE Healthcare). 10 µL anti-human IgG (monoclonal mouse anti-human Fc) from human antibody capture kit (GE Healthcare) was diluted to 25 µL/mL in 200 µL final immobilization buffer (10 mM sodium acetate, pH 5.0). The flow rate was set to 5 µL/min, flowpath 1. Fifty µL N-hydroxysuccinamide (NETS) and 50 µL 1-ethyl-3-(3-dimethylaminopropyl) carbidiimide (EDC) were mixed and injected for 420 sec to activate the CM5 chip surface. The diluted antibody was injected for 360 seconds followed by 1 M ethanolamine for 420 seconds. The flowpath was then switched to flowpath 2. A new EDC/NHS mixture was prepared and the procedure was repeated for flow cell 2. The surface was conditioned by 2 injections of 30 sec using flowpath 1, 2 at 30 µL/min of 3M $MgCl_2$. For the anti-mouse surface, 10 µL anti-mouse IgG (polyclonal rabbit anti-mouse IgG) from mouse antibody capture kit (GE Healthcare) was diluted to 30 µL/mL in 324 µL final immobilization buffer (10 mM sodium acetate, pH 5.0). The flow rate was set to 5 µL/min, flowpath 3. Fifty µL NHS and 50 µL EDC were mixed and injected for 420 sec to activate the chip surface. The diluted antibody was injected for 420 sec. 1 M ethanolamine was injected for 420 sec. Flow path was switched to flowpath 4. A new EDC/NHS mixture was prepared and the procedure was repeated for flow cell 4. The surface was conditioned by 2 injections of 30 sec using flowpath 3, 4 at 30 µL/min of 10 mM glycine, pH 1.7.

Final immobilization levels were:
Flow cell 1—10,000 RU (anti-human)
Flow cell 2—10,092 RU (anti-human)
Flow cell 3—11,824 RU (anti-mouse)
Flow cell 4—11,216 RU (anti-mouse)

10A.f.1.ii. Binding Assay

The running buffer used for the binding assay was PBS-P+/0.2% BSA. All antibodies were diluted to 1 µg/mL in PBS-P+/0.2% BSA (same preparation as used for running buffer), centrifuged at 14,000 g for 5 min at room temperature, and the supernatant was transferred to a new tube. Analyte (Tau monomer 2N4R wt, 2.15 mg/mL, 47 µM) was diluted to 100 nM in PBS-P+/0.2% BSA, centrifuged at 14,000 g for 5 min at room temperature, and the supernatant transferred to a new tube. 100 nM solution was serially-diluted 5-fold into PBS-P+/0.2% BSA. Final concentrations were 100 nM, 20 nM, 4 nM, 0.8 nM, 0.16 nM, 0.032 nM, and 0 nM. Humanized antibodies were captured on flow cell 2 at a flow rate of 10 µL/min for a contact time of 60 sec. Murine antibodies were captured on flow cell 4 at a flow rate of 10 µL/min for a contact time of 60 sec. Dilutions of Tau protein were injected over all 4 flow cells at a flow rate of 30 µL/min for a contact time of 240 sec. Dissociation was followed for 900 sec. Following each cycle, surface was regenerated by a 30 sec injection (flowpath 1, 2) at 30 µL/min of 3M $MgCl_2$, a 30 sec injection (flowpath 3, 4) at 30 µL/min of 10 mM glycine, pH 1.7, a 30 sec injection (flowpath 1, 2) at 30 µL/min of 3 M $MgCl_2$, followed by two 30-sec injections (flowpath 3, 4) at 30 µL/min of 10 mM glycine, pH 1.7. After the run, data collected was fitted to a steady-state binding model using all concentrations using BIAEvaluations. Kinetic data fitting was performed using a 1:1 Langmuir model, excluding the 100 nM trace (inclusion of 100 nM trace resulted in unacceptably high $X^2$ values). A subset of antibody binding data was also analyzed using a 2-state model.

10A.f.2. Anti-Human Capture Monomeric Tau-Binding Assay 10A.f.2.i. Chip Preparation Chip preparation was performed using a BIAcore™ T-100 instrument. Chip preparation was performed using the method wizard for immobilization. Running buffer was HBS-P+. Fifteen µL anti-human IgG (monoclonal mouse anti-human Fc) from human antibody capture kit (GE Healthcare) was diluted to 25 µL/mL in 300 µL final immobilization buffer (10 mM sodium acetate, pH 5.0). The flow rate was set to 5 µL/min. Immobilization was performed on all four flow cells with a ligand contact time of 360 sec. The surface was conditioned by two injections of 30 sec using flowpath 1, 2, 3, 4 at 30 µL/min of 3 M $MgCl_2$.

Final immobilization levels were:
Flow cell 1—7341 RU
Flow cell 2—7683 RU
Flow cell 3—7530 RU
Flow cell 4—6303 RU 10A.f.2.ii. Binding Assay Binding experiments were performed using a BIOcore™ T-100 instrument or a T-200 instrument. Running buffer used for the binding assay was PBS-P+/0.2% BSA. All antibodies were diluted to 2 µg/mL in PBS-P+/0.2% BSA (the same preparation as used for the running buffer), centrifuged at 14,000 g for 5 min at room temperature, and the supernatant transferred to new tube. Analyte (Tau monomer 2N4R wt, 2.15 mg/mL, 47 µM) was diluted to 100 nM in PBS-P+/0.2% BSA, centrifuged at 14,000 g for 5 min at room temperature, and the supernatant transferred to a new tube. 100 nM solution was serially-diluted 5-fold into PBS-P+/0.2% BSA. Final concentrations were 100 nM, 20 nM, 4 nM, 0.8 nM, 0.16 nM, 0.032 nM, and 0 nM. Humanized antibodies were captured on flow cells 2, 3, and 4 sequentially at a flow rate of 10 µL/min for a contact time of 60 sec. Dilutions of Tau protein were injected over all 4 flow cells at a flow rate of 30 µL/min for a contact time of 240 sec. Dissociation was followed for 900 sec. Following each cycle, the surface was regenerated by two sequential injections of 30 sec at 30 µL/min of 3 M $MgCl_2$ over all four flow cells. After the run, kinetic data fitting was performed using a 1:1 Langmuir model, excluding the 100 nM trace (inclusion of 100 nM trace resulted in unacceptably high X2 values).

10A.f.3. Streptavidin Capture Monomeric Tau-Binding Assay 10A.f.3.i. Antibody Preparation 400 µg of each antibody was diluted to 2 mg/mL and buffer-exchanged into 0.1 M sodium bicarbonate, pH 8.3 using 0.5 mL Zeba™ 40 kDa MWCO desalting columns (Thermo). NHS-PEG4-biotin, prepared immediately before use by dissolving in water to a 20 mM final stock concentration, was added to antibodies at a 5:1 molar ratio (biotin: MAb) and conjugated for 1 hr at room temperature. Excess biotin was removed by two sequential buffer exchanges into 1×DPBS using 0.5 mL Zeba™ 40 kDa MWCO desalting columns. For the BIAcore™ assay, antibodies were diluted to 2 µg/mL in PBS-P+/0.2% BSA (the same preparation used for the running buffer), centrifuged at 14,000 g for 5 min at room temperature, and the supernatant transferred to a new tube. Injection time was subsequently determined for each antibody to achieve a capture level of ~225 RU.

Wild-type 2N4R Tau protein (2.15 mg/mL, 47 µM) was diluted to 100 nM in PBS-P+/0.2% BSA, centrifuged at 14,000 g for 5 min at room temperature, and supernatant transferred to a new tube. 20 nM solution was serially-diluted 5-fold into PBS-P+/0.2% BSA. Final concentrations were 20 nM, 4 nM, 0.8 nM, 0.16 nM, and 0 nM.

10A.f.3.ii. Binding Assay

The biosensor chip used was a CAP chip from the biotin CAPture™ kit (GE Healthcare, cat 28-9202-34). All experiments were performed using a T-100 instrument. CAP reagent was immobilized on all four flow cells (flowpath 1, 2, 3, 4) at a flow rate of 2 µL/min for 5 min (final streptavidin level was ~3500 RU). Biotinylated humanized antibodies, biotinylated chimeric 7G6, or biotinylated murine ms7G6 were captured on flow cells 2, 3, and 4 sequentially at a flow rate of 10 µL/min for a contact time of 80 sec to 146 sec (biotinylated chimeric antibody contact time was 240 sec). Dilutions of Tau protein were injected over all four flow cells at a flow rate of 30 µL/min for a contact time of 180 sec in sequence from 0 nM to 20 nM. Following the last injection (20 nM Tau), dissociation was followed for 900 sec. After each cycle, the surface was regenerated by one injection of 120 sec 10 µL/min of 6 M Guanidine HCl, 0.25 M NaOH over all four flow cells. Samples were assayed in duplicate, except for murine 7G6 and 7G6-zuHC25-zuLC18, which were analyzed in duplicate on two separate flow cells (total of 4 analyses for each). After the run, kinetic data fitting was performed using a 1:1 Langmuir model using single cycle kinetics.

10A.g. Size Exclusion Chromatography-High Performance Liquid Chromatography (SEC-HPLC)

SEC-HPLC was performed on an Agilent 1260 quaternary pump HPLC system equipped with an AdvanceBio™ SEC 300A, 2.7 µm, 4.6 mm ID×50 mm guard column, and AdvanceBio™ SEC 300A, 2.7 µm, 4.6 mm ID×300 mm column (Agilent). The isocratic flow of a mobile phase consisting of 0.1 M sodium phosphate (pH 6.5) was at 0.35 mL/min. The separation was conducted at ambient temperature. The column effluent was monitored at 280 nm. Fifty µg of sample (10 µL of 5 mg/mL sample) was injected for each run; each sample was analyzed twice. Peak integration was performed using Agilent OpenLAB software. Retention time, peak height, peak area, peak width, and peak symmetry were reported. The percentage of aggregates and monomers were calculated based on the peak area.

10A.h. Differential Scanning Calorimetry (DSC) Analysis

VP Capillary Differential Scanning calorimeter (VP-CapDSC; MicroCal, VP-CapDSC, s/n 12-07-149 with Origin-7 graphing and MicroCal VP-Capillary DSC Software v.2.0) was used to decipher and compare the higher order structure and thermal stability of various F(ab')$_2$ fragments and controls. Samples were allowed to acclimate to ambient temperature for 30 minutes, followed by vortexing. The entire sample (0.4-0.5 mL) was added to appropriate wells of an assay plate (Microliter Analytical Supply, 96 well, 500 µL, round well and bottom, cat #07-2100; Sun Suri plate cover cat #300-005). 0.5 mL of 20% Contrad solution and 0.5 mL water were added to the appropriate wells of the assay plate. Sealed plates were placed into an auto-sampler at 10° C.

The run was programmed and initiated using the following assay parameters:

DSC Controls:
Start Temperature=25° C.
Final Temperature=100° C.
Scan Rate=100° C./Hr
Number of Rescans=0
Rescan Cooling Rate=EXP
Pre-scan Thermostat=10 Minutes
Post-scan Thermostat=5 Minutes
Post-Cycle Thermostat=25° C.
Filtering Period=10 Seconds
Autofill Cells at =30° C.
Feedback Mode/Gain=None
Unique Scans
Sample Parameters:
Concentration=mM
File Parameters=Auto #
Rinse Station=select Wash 2 (So will Wash 2 (1×PBS) then Wash 1 (Water))
Thermostat Control Set Point=25° C.
Pulse Control:
Pulse Size=−3
Duration=600
Pulse Off
Y-Axis Scale Units=mCal/Minute
Clean in-line with Contrad/Contrad at 25-70° C., 100° C./Hour followed by two Buffer/Buffer injections.

10B. Results 10B.a. IGHV1/IGKV2 Humanization 10B.a.1 7G6 in Silico Modelling

The human germline variable domain protein sequences most homologous to mouse ms7G6 mAb were retrieved using BLAST at www_ncbi_nlm_nih_gov/igblast www_imgt_org/3Dstructure-DB/cgi/DomainGapAlign.cgi. IGHV1-46*03 and IGKV2-30*02 variable domain families were the most homologous sequences to ms7G6 (FIG. 11). Mouse framework sequences were replaced with the closest homologous human germline sequences to generate CDR-grafted humanized variants.

The mouse and CDR-grafted sequences were used to generate in silico models of the variable domains. The theoretical structure of the mouse and humanized models were superimposed, and residues in close proximity to the CDRs were analyzed for potential structural influence on the overall structure of the CDR loops. While most of the differing residues were not located at the dimer interface or were distal to the CDRs, several residues were found to be in close proximity (within 5 Å) of the CDRs.

In the Vκ domain, the hydroxyl group in mouse Tyr36 formed a potential hydrogen bond with Trp100 in CDRH3. The human Phe36 loses this hydrogen bond, which may affect the structural integrity of CDRH3. Human Arg46 is much bulkier than the mouse Leu46, and Arg46 may sterically hinder proper folding of the CDRs. Similarly, in the Vh domain, position 71 was positioned against the CDRs. The human Arg71 may sterically hinder proper folding of the CDRs compared to the mouse Val71. The human Val78 was positioned similarly and is bulkier than the mouse Ala78. Therefore Val78 may, but was unlikely to, affect the integrity of the CDRs.

The mouse ms7G6 antibody contained two unpaired cysteines that may be problematic in the development of the mAb due to the presence of free thiols which could contribute to product aggregation, oxidation, cysteinylation, or glutathionylation. One Cys was located at position 57 in CDRH2 and the second was at position 49 in FWRL2.

The Kabat definition of CDRH2 extends 8 C-terminal amino acids longer than the IMGT definition. The latter 8 amino acids were analyzed for their proximity and potential contribution to antigen binding. Asn58 was within the potential antigen binding site at the potential CDR-antigen interface at the top of the variable domains. Residues 60, 61, 64, and 65 differing between mouse and the human germline sequence were outside of the potential antigen binding site and were not likely to directly contact the antigen or provide structural support for proper CDR folding.

10B.a.2. Humanized Vh1 and Vκ2 Variants and Analysis for Tau Binding by ELISA

A series of humanized mutants were generated using the germline variable domain Vh1 and Vκ2 families to evaluate the importance of mouse residues at the positions predicted by in silico modeling to be important for CDR-antigen interactions (FIG. 12). Humanized and mouse 7G6 residues were analyzed at Vh positions 60, 61, 64, 65, 71, and 78 in various combinations (7G6-HCzu1-4), as well as the C57S mutation (7G6-HCzu5). Combinations of human and mouse residues at positions 36, 46, and 49 in ms7G6 Vκ were also analyzed (7G6-LCzu1-5) as well as the C49S mutation (7G6-LCzu6). MAbs were expressed in a matrix format whereby every combination of humanized HCs and LCs were cotransfected, except 7G6-HCzu5 was only coexpressed with 7G6-LCzu2 and 7G6-LCzu6 was only coexpressed with 7G6-HCzu3.

To test direct binding to Tau, 2N4R Tau was coated on 96-well plates and various concentrations of humanized mAbs were added to the wells. MAbs bound to Tau were detected with either an HRP-conjugated anti-mouse antibody (mouse [ms]7G6) or anti-human antibody (remaining samples). Samples were incubated for 1 h at room temperature in 96-well plates coated with 2N4R Tau. Following washing, HRP-conjugated anti-mouse or anti-human detection antibodies were added to the wells. The anti-mouse antibody was used to detect ms7G6. The amount of HRP activity in each well was measured by QuantaBlu fluorescent substrate and the RFUs were detected by a SpectraMax M5 plate reader.

Data from the samples, grouped according to the LC variant, except the cysteine mutants which are grouped on the bottom-most graph, is shown in FIGS. 13A-13F. Amongst all of the 7G6 HC and LC variants, there was little difference in Tau binding (FIGS. 13A-F; Table 3). Although ms7G6 showed better binding than the humanized variants, it should be noted that this result may be misleading due to the differing detection antibodies between the mouse and human samples. mAb2 corresponds to non-Tau-binding control IgG antibody.

TABLE 3

EC50s* of humanized 7G6 Vh1/Vκ2 variants binding Tau

| Ab | EC50 |
|---|---|
| 7G6-HCzu1-LCzu1 | 119.2 |
| 7G6-HCzu2-LCzu1 | 104.7 |
| 7G6-HCzu3-LCzu1 | 131.4 |
| 7G6-HCzu4-LCzu1 | 184.7 |
| 7G6-HCzu1-LCzu2 | 133.1 |
| 7G6-HCzu2-LCzu2 | 208.9 |
| 7G6-HCzu3-LCzu2 | 171.6 |
| 7G6-HCzu4-LCzu2 | 168.2 |
| 7G6-HCzu1-LCzu3 | 164.9 |
| 7G6-HCzu2-LCzu3 | 152.3 |
| 7G6-HCzu3-LCzu3 | 188.9 |
| 7G6-HCzu4-LCzu3 | 176.5 |
| 7G6-HCzu1-LCzu4 | 191.7 |
| 7G6-HCzu2-LCzu4 | 226.9 |
| 7G6-HCzu3-LCzu4 | 253 |
| 7G6-HCzu4-LCzu4 | 282.6 |
| 7G6-HCzu1-LCzu5 | 167.1 |
| 7G6-HCzu2-LCzu5 | 186.9 |
| 7G6-HCzu3-LCzu5 | 183.6 |
| 7G6-HCzu4-LCzu5 | 199.4 |
| 7G6-HCzu5-LCzu2 | 147 |
| 7G6-HCzu5-LCzu2 | 154.2 |
| 7G6-HCzu3-LCzu6 | 135 |
| ms7G6 | 34.36 |

*The EC50s were determined by fitting a non-linear regression curve in GraphPad Prism 6.05.

To reduce any potential immunogenicity, another series of mutants was generated with increasing numbers of human residues (7G6-HCzu6, 7G6-HCzu 7, and 7G6-HCzu 8; FIG. 12). Since Vh Ser57 showed little difference in binding to Cys57, most of the mutants contained Ser57. To further confirm that serine was a viable substitution for cysteine at position 57, two mutant pairs differing at only position 57 were generated (7G6-HCzu7 and 7G6-HCzu9 and 7G6-HCzu8 and 7G6-HCzu10; FIG. 12).

All Vκ variants were engineered with Ser49, except 7G6-LCzu10 which was made to determine whether the human residue Tyr49 was a viable substitute for Cys49. 7G6-LCzu7 was analogous to 7G6-LCzu1 and 7G6-LCzu3 except with Ser49. 7G6-LCzu21 was analogous to 7G6-LCzu5 and 7G6-LCzu22 was analogous to 7G6-LCzu4, again with Ser49. 7G6-LCzu8 had a valine at position 30 to determine whether the human residue at this position retained Tau binding. Position 34 was somewhat buried in the structure and it was possible it did not contribute to antigen binding, therefore the human residue Asn34 at the end of CDRL1 was engineered into 7G6-LCzu9. All HC variants were coexpressed with 7G6-LCzu6 and all LC variants were coexpressed with 7G6-HCzu5.

Figure 14:
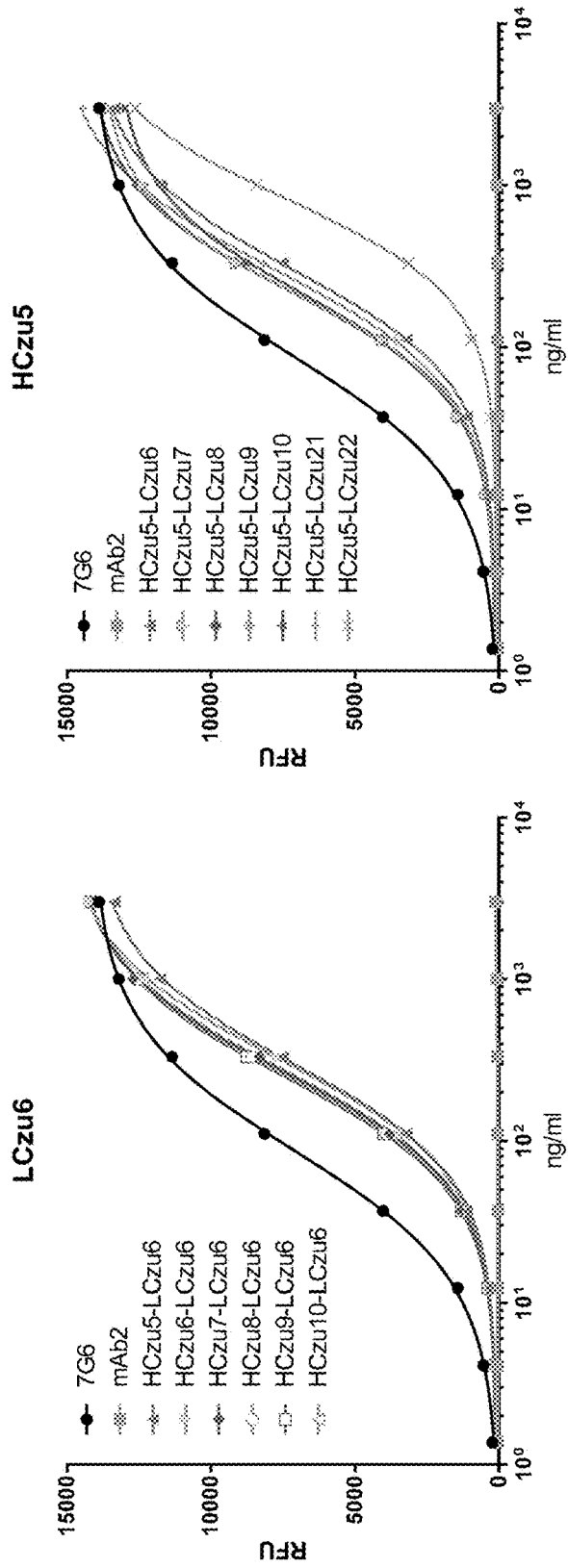
FIG. 14 illustrates the results of Tau binding by humanized 7G6 Vh1/Vk2 variants analyzed by a direct ELISA. Samples were incubated for 1 h at room temperature in 96-well plates coated with 2N4R Tau. Plates were washed and then HRP-conjugated anti-mouse or anti-human antibodies were added to the wells. The amount of HRP activity in each well was measured by QuantaBlu™ fluorescent substrate and the relative fluorescence units (RFUs) were detected by a SpectraMax M5 plate reader. The majority of the mAbs showed little difference in Tau binding in a direct ELISA assay. The notable exception was 7G6-LCzu9 which exhibited no binding, even at the highest concentrations. In addition, 7G6-LCzu22 showed reduced binding; Vκ Tyr36 in combination with Arg46 resulted in disruption of the antigen binding site.

Tau binding was analyzed by a direct ELISA as above. Samples were incubated for 1 hour at room temperature in 96-well plates coated with wild-type 2N4R Tau. After a wash step, HRP-conjugated anti-mouse or anti-human detection antibodies were added to the wells. The anti-mouse antibody was used to detect ms7G6. The amount of HRP activity in each well was measured by QuantaBlu fluorescent substrate and the RFUs were detected by a SpectraMax M5 plate reader. A majority of the mAbs showed little difference in Tau binding in a direct ELISA assay (FIG. 14; Table 4). The notable exception was LCzu9 which exhibited no binding, even at the highest concentrations. Therefore, Vκ Glu34 was critical for antigen binding. In addition, LCzu22 showed reduced binding; Vκ Tyr36 in combination with Arg46 resulted in disruption of the antigen binding site.

TABLE 4

EC50s* of humanized 7G6 Vh1/Vκ2 variants binding Tau

| | EC50 |
|---|---|
| 7G6-HCzu5-LCzu6 | 299.8 |
| 7G6-HCzu6-LCzu6 | 320.9 |
| 7G6-HCzu7-LCzu6 | 270.3 |
| 7G6-HCzu8-LCzu6 | 256.5 |
| 7G6-HCzu9-LCzu6 | 250.4 |
| 7G6-HCzu10-LCzu6 | 277.7 |
| 7G6-HCzu5-LCzu7 | 212.1 |
| 7G6-HCzu5-LCzu8 | 221 |
| 7G6-HCzu5-LCzu9 | NB |
| 7G6-HCzu5-LCzu10 | 209.6 |
| 7G6-HCzu5-LCzu21 | 301.5 |
| 7G6-HCzu5-LCzu22 | 813.9 |
| ms7G6 | 86.33 |

*The EC50s were determined by fitting a non-linear regression curve in GraphPad Prism 6.05.
NB (no binding) indicates little to no binding to Tau.

Binding of humanized and mouse antibodies were analyzed by surface plasmon resonance (BIAcore™) to determine their relative association rates ($k_a$), dissociation rates ($k_d$), and equilibrium binding constants ($K_D$). Anti-mouse or anti-human antibodies were immobilized on a CM5 chip and sample mAbs were captured on the chip. 2N4R Tau was flowed over the chip and binding observed. The binding constants $k_a$, $k_d$, and $K_D$ were determined using a 1:1 Langmuir fitting model. Antibody ms7G6 derived from hybridoma or IgG2a or IgG2b recombinant material showed no difference in the association or dissociation rates (Table 5). Among the 7G6 HC variants, there were only slight differences, and the cysteine to serine mutations did not affect Tau binding. 7G6-LCzu2, LCzu6, LCzu7, LCzu8, and LCzu21 bound Tau similarly, demonstrating that the amino acids differing between these mAbs had little impact on binding. The humanized samples demonstrated better binding to Tau than the mouse mAbs, but this was most likely due to the necessity of using different capture antibodies in this assay format.

TABLE 5

BIAcore™ analysis of mouse and humanized Vh1/Vκ2

| MAb | Species/Isotype | $k_a$ ($\times 10^5$ $M^{-1}sec^{-1}$) | $k_d$ ($\times 10^{-3}$ $sec^{-1}$) | $K_D$ (nM) |
|---|---|---|---|---|
| 7G6-HCzu1-LCzu1 | human/IgG1 | 25.70 | 0.519 | 0.202 |
| 7G6-HCzu2-LCzu1 | human/IgG1 | 28.30 | 0.640 | 0.226 |
| 7G6-HCzu3-LCzu1 | human/IgG1 | 27.70 | 0.856 | 0.309 |
| 7G6-HCzu4-LCzu1 | human/IgG1 | 35.70 | 0.847 | 0.237 |
| 7G6-HCzu1-LCzu2 | human/IgG1 | 22.00 | 0.241 | 0.110 |
| 7G6-HCzu2-LCzu2 | human/IgG1 | 21.20 | 0.214 | 0.101 |
| 7G6-HCzu3-LCzu2 | human/IgG1 | 20.00 | 0.242 | 0.121 |
| 7G6-HCzu4-LCzu2 | human/IgG1 | 20.00 | 0.242 | 0.121 |
| 7G6-HCzu5-LCzu2 | human/IgG1 | 18.60 | 0.237 | 0.127 |
| 7G6-HCzu3-LCzu6 | human/IgG1 | 19.00 | 0.227 | 0.120 |
| 7G6-HCzu5-LCzu6 | human/IgG1 | 21.4 | 0.206 | 0.0961 |
| 7G6-HCzu6-LCzu6 | human/IgG1 | 22.1 | 0.213 | 0.0961 |
| 7G6-HCzu7-LCzu6 | human/IgG1 | 20.8 | 0.226 | 0.109 |
| 7G6-HCzu8-LCzu6 | human/IgG1 | 21.7 | 0.21 | 0.0968 |
| 7G6-HCzu9-LCzu6 | human/IgG1 | 20.6 | 0.193 | 0.0938 |
| 7G6-HCzu10-LCzu6 | human/IgG1 | 19.8 | 0.213 | 0.108 |
| 7G6-HCzu5-LCzu7 | human/IgG1 | 31.4 | 0.304 | 0.0968 |
| 7G6-HCzu5-LCzu8 | human/IgG1 | 36 | 0.298 | 0.0828 |
| 7G6-HCzu5-LCzu9 | human/IgG1 | no binding | no binding | no binding |
| 7G6-HCzu5-LCzu10 | human/IgG1 | 32.7 | 0.53 | 0.162 |
| 7G6-HCzu5-LCzu21 | human/IgG1 | 29.3 | 0.278 | 0.095 |
| 7G6-HCzu5-LCzu22 | human/IgG1 | 18.8 | 2.77 | 1.48 |
| Hybridoma ms7G6 | mouse/IgG2b | 4.64 | 1.533 | 3.305 |
| recombinant ms7G6 | mouse/IgG2b | 3.73 | 1.556 | 4.170 |
| recombinant ms7G6 | mouse/IgG2a | 5.49 | 1.497 | 2.725 |

These data, along with the data from ELISA assay, demonstrated the requirement for 7G6 Vκ Glu34 and the detrimental combination of 7G6 Vκ Tyr36 and Arg46. 7G6 Vκ residues Tyr36 and Leu46 in LCzu6 were slightly favored over the human Phe36 and Arg46 residues in 7G6-LCzu7 and 7G6-LCzu8, but retaining the human residues at these positions outweighed the minor reduction in the $k_d$. The human Vκ Tyr57 in 7G6-LCzu10 had a significant impact on the $k_d$.

10B.a.3. SDS-PAGE Analysis of HC/LC Stability for Vh1 and Vκ2 Variants

Figure 15:
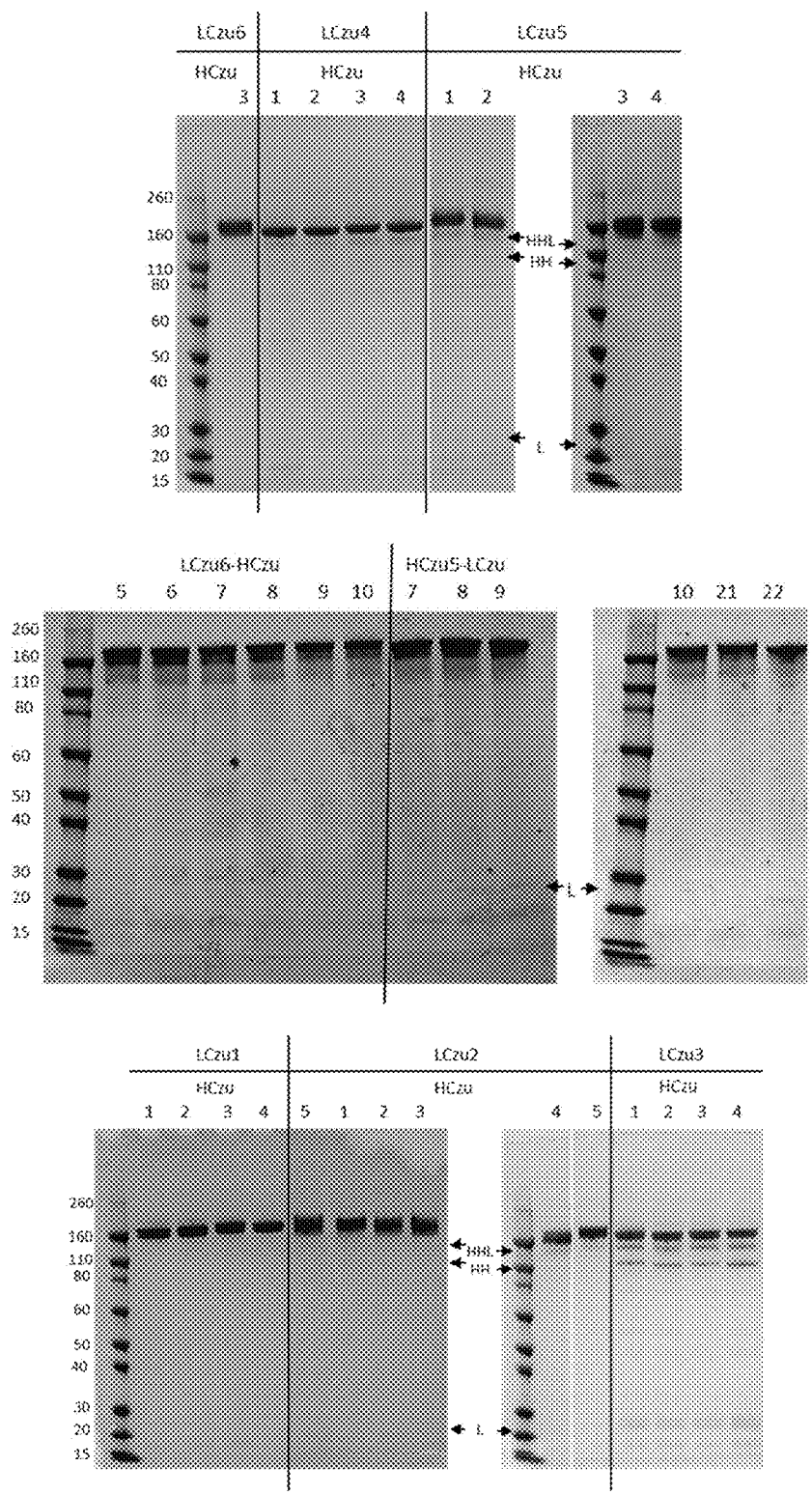
FIG. 15 illustrates results of the SDS-PAGE analysis of heavy chain and light chain stability for the Vh1 and Vκ2 humanized 7G6 variants. Two micrograms of each mAb were mixed with 4× NuPAGE™ LDS Sample Buffer in the absence of reducing agent and loaded onto a 4-12% Bis-Tris SDS-PAGE gel in MOPS buffer. Gels were stained with InstantBlue™ and destained in water. HC—HC-LC trimers (HHL), HC—HC dimers (HH), and free LC (L) are indicated by arrows. The molecular weight of the markers is indicated in kDa.

Two micrograms of each mAb were mixed with 4× NuPAGE™ LDS Sample Buffer and separated non-reduced on a 4-12% Bis-Tris SDS-PAGE gel in MOPS buffer. Gels were stained with InstantBlue™ and destained in water. All mAbs with Cys49 in the LC (7G6-LCzu2, 7G6-LCzu3, 7G6-LCzu4, and 7G6-LCzu5) were not stable, and under non-reducing conditions, HC—HC-LC trimers, HC—HC dimers, and free LC were separated by SDS-PAGE (FIG. 15). 7G6-LCzu2 had fewer lower molecular weight species, likely due to this Vκ having two additional mouse residues, Tyr36 and Leu46, stabilizing the Vh-Vκ interaction. 7G6-LCzu3, 7G6-LCzu4, and 7G6-LCzu5 had one or both of these residues changed to the human Phe36 and/or Arg46. The least stable mAbs were the LCzu3 variants with both human residues. 7G6-LCzu7, 7G6-LCzu8, 7G6-LCzu9, and 7G6-LCzu22 had a small amount of free light chain, suggesting the HC and LC interaction in these samples may not be optimal, resulting in a small amount of antibodies not forming the HC-LC interchain disulfide bond. As with 7G6-LCzu3, these LC variants have human residues at one or both positions 36 and 46. 7G6-LCzu10 and 7G6-LCzu21 also have human residues at these positions, but no free LC was seen, possibly a result of incomplete staining by the InstantBlue™ stain.

10B.b IGHV3/IGKV1 Humanization 10B.b.1 Humanized Vh3 and Vκ1 Variants and Analysis for Tau Binding by ELISA The humanized 7G6 variants discussed above utilized the human germline variable domain families IGHV1 and IGKV2 chosen based on their similarity to ms7G6. However, these families are underrepresented in the human population, thereby increasing the chance the humanized variants would be immunogenic in patients (Brezinschek H P, Foster S J, Dorner T, Brezinschek R I, Lipsky P E. Pairing of variable heavy and variable kappa chains in individual naive and memory B cells. J Immunol. 1998 May 15; 160(10):4762-7; Jayaram N, Bhowmick P, Martin A C. Germline Vh/VK pairing in antibodies. Protein Eng Des Sel. 2012 October; 25(10):523-9; Tiller T, Schuster I, Deppe D, Siegers K, Strohner R, Herrmann T, Berenguer M, Poujol D, Stehle J, Stark Y, HeBling M, Daubert D, Felderer K, Kaden S, Kölln J, Enzelberger M, Urlinger S. A fully synthetic human Fab antibody library based on fixed Vh/VK framework pairings with favorable biophysical properties. MAbs. 2013 May-June; 5(3):445-70). Therefore the ms7G6 CDRs were grafted onto the more common IGHV3 and IGKV1 families (FIG. 16).

The aforementioned in silico model of ms7G6 was analyzed as above for human residues in close proximity (5 Å) of the CDRs. Human residues in Vh at positions 49, 71, 76, 78, and 94 and in Vκ at positions 2 and 57 were identified as potential critical framework residues. Two humanized variants of the Vh and Vκ were generated, one with all human framework residues (7G6-HCzu11; 7G6-LCzu11) and one with potentially critical residues back-mutated (7G6-HCzu12; 7G6-HCzu12) (FIG. 17). Both HCs were coexpressed with both LCs.

Figure 18:
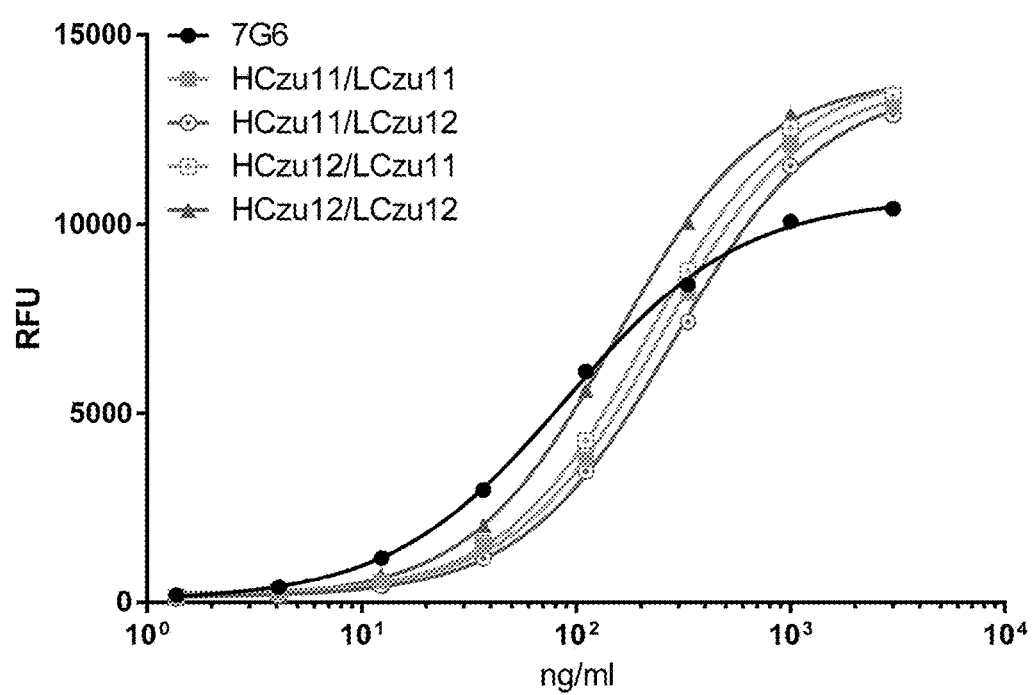
FIG. 18 demonstrates direct binding of Tau by ms7G6 and humanized 7G6Vh3/Vκ1 variants 7G6-HCzu11-LCzu11 ("HCzu11-LCzu11"), 7G6-HCzu11-LCzu12 ("HCzu11-LCzu12"), 7G6-HCzu12-LCzu11 ("HCzu12-LCzu11"), and 7G6-HCzu12-LCzu12 ("HCzu12-LCzu12"). Samples were incubated for 1 h at room temperature in 96-well plates coated with 2N4R wild-type recombinant Tau protein. After washing, HRP-conjugated anti-mouse or anti-human antibodies were added to the wells. The amount of HRP activity in each well was measured by QuantaBlu™ fluorescent substrate and the RFUs were detected by a SpectraMax M5 plate reader.

2N4R Tau was coated on 96-well plates and various concentrations of humanized mAbs were added to the wells as above. MAbs bound to Tau were detected with either an HRP-conjugated anti-mouse antibody (ms7G6) or anti-human antibody (remaining samples). All humanized mAbs bound similarly to Tau, but the 7G6-HCzu12-LCzu12 mAb had the lowest EC50 (FIG. 18 & Table 6). Both mouse mAbs showed better binding than the humanized variants, possibly due to the different detection antibodies used between the mouse and human samples. These data suggest that at least some of the human residues in proximity to the CDRs negatively affect antigen binding.

TABLE 6

EC50s of humanized 7G6Vh1/Vκ2 variants binding Tau

| Ab | EC50 |
|---|---|
| ms7G6 | 89.88 |
| 7G6-HCzu11-LCzu11 | 245.9 |
| 7G6-HCzu11-LCzu12 | 284.2 |
| 7G6-HCzu12-LCzu11 | 218.4 |
| 7G6-HCzu12-LCzu12 | 153.4 |

The EC50s were determined by fitting a non-linear regression curve in GraphPad Prism 6.05.

To reduce potential immunogenicity, another series of mutants was generated with increasing numbers human residues. Residues in the C-terminal half of CDRH2 had little impact on Tau binding in Vh1-based variant 7G6-HCzu4. Therefore, these residues were changed to the Vh3 germline residues in 7G6-HCzu13, 7G6-HCzu14, 7G6-HCzu19 and 7G6-HCzu20 (FIG. 17). Variants of 7G6-HCzu12 were made such that mouse residues were replaced with human in order of probable increasing importance on antigen binding, based on the in silico ms7G6 model. For instance, the sidechain of Ser76 was on a loop facing away from the CDRs and was the least likely residue to impact the CDR-antigen interaction. Therefore it was the first residue to be changed to human residue Asn76 in 7G6-HCzu15. Residue 49 was mutated next (7G6-HCzu16), then 78 (7G6-HCzu17), 71 (7G6-HCzu18), and finally 94 (7G6-HCzu20).

With little difference between 7G6-LCzu11 and 7G6-LCzu12, it was expected that human residues at positions 2 and 57 would have little impact on antigen binding. Therefore, each of these was mutated one at a time. For position 57, tyrosine and serine substitutions were analyzed. A valine at position 30 was introduced in 7G6-LCzu16 and 7G6-LCzu17. The human residue Asn34 at the end of CDRL1 was engineered into 7G6-LCzu17. All HC variants were coexpressed with 7G6-LCzu12 and all LC variants were coexpressed with 7G6-HCzu12.

Figure 19A:
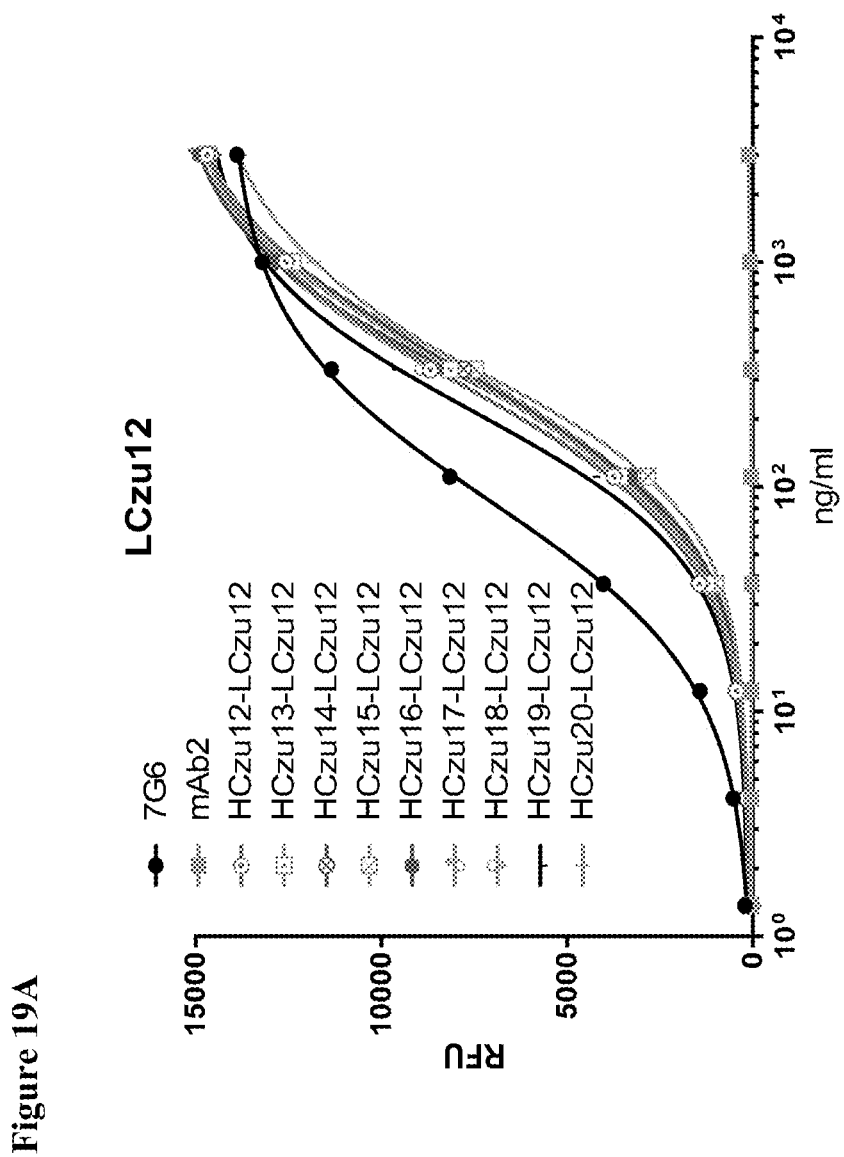
FIGS. 19A and 19B demonstrate direct binding of Tau by ms7G6, non-Tau binding IgG1 control Ab mAb2, and humanized 7G6 Vh3/Vκ1 variants.
Figure 19B:
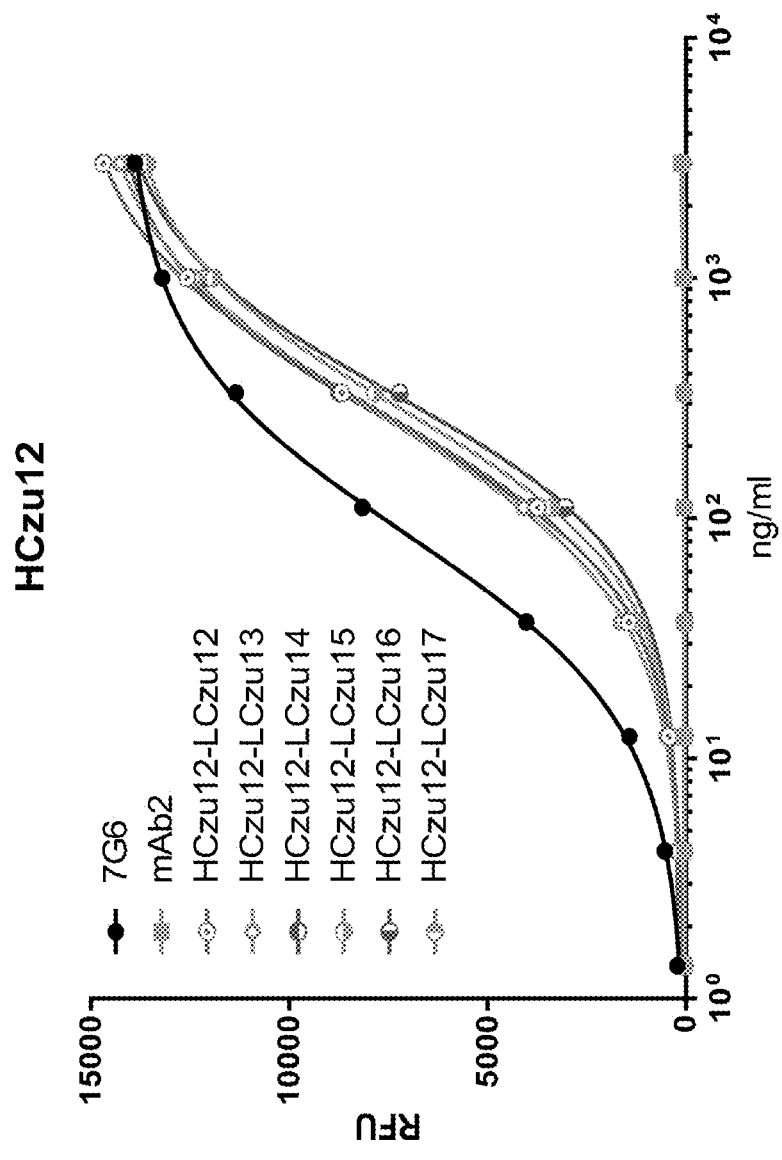

A majority of the mAbs showed little difference in Tau binding in a direct ELISA assay (FIG. 19 & Table 7). The notable exception was LCzu17 which exhibited no binding, even at the highest concentrations. Therefore, Vκ Glu34 was critical for antigen binding.

TABLE 7

EC50s of humanized 7G6Vh1/Vκ2 variants binding Tau

| Ab | EC50 |
| --- | --- |
| 7G6-HCzu12-LCzu12 | 283.4 |
| 7G6-HCzu13-LCzu12 | 320.1 |
| 7G6-HCzu14-LCzu12 | 335.1 |
| 7G6-HCzu15-LCzu12 | 358 |
| 7G6-HCzu16-LCzu12 | 313.1 |
| 7G6-HCzu17-LCzu12 | 341.6 |
| 7G6-HCzu18-LCzu12 | 278.4 |
| 7G6-HCzu19-LCzu12 | 216.4 |
| 7G6-HCzu20-LCzu12 | 317.2 |
| 7G6-HCzu12-LCzu13 | 263.3 |
| 7G6-HCzu12-LCzu14 | 248.6 |
| 7G6-HCzu12-LCzu15 | 287.6 |
| 7G6-HCzu12-LCzu16 | 328.8 |
| 7G6-HCzu12-LCzu17 | NB |
| ms7G6 | 86.33 |

The EC50s were determined by fitting a non-linear regression curve in GraphPad Prism 6.05.
NB (no binding) indicates little to no binding to Tau.

10B.b.2 BIAcore™ Analysis of Tau Affinity for Vh3 and Vκ1 Variants

Binding of humanized and mouse antibodies were analyzed by BIAcore™ to determine their relative association rates (ka), dissociation rates (kd), and equilibrium binding constants ($K_D$). Anti-mouse or anti-human antibodies were immobilized on a CM5 chip and sample mAbs were captured on the chip. 2N4R Tau was flowed over the chip and binding observed. The binding constants $k_a$, $k_d$, and $K_D$ were determined using a 1:1 Langmuir fitting model. Both 7G6-HCzu12-based mAbs had similar $k_a$ and $k_d$ values (Table 8). However, the $k_a$ of 7G6-HCzu11 was decreased, though the $k_d$ was unaffected. Therefore, human residues in the Vh3 framework impact binding to Tau. As with the ELISA assay, 7G6-LCzu17 did not bind Tau. The difference in $k_d$ between 7G6-HCzu12, 7G6-HCzu13, and 7G6-HCzu14 suggests the CDRH2 C-terminal human residues have a negative impact on antigen binding. The decrease in $k_d$ was not observed for 7G6-HCzu19 and 7G6-HCzu20 which also have human residues in the region; however, these mAbs had a decrease in $k_a$. 7G6-HCzu15 did not bind to the chip very well, and the data from this mAb were questionable. While no specific data on the single S76N mutation was available, the $k_a$ and $k_d$ values for 7G6-HCzu16, 7G6-HCzu17, 7G6-HCzu18 were similar to 7G6-HCzu12 suggesting the S76N mutation should not affect Tau binding. The $k_a$ for 7G6-HCzu20 was less than 7G6-HCzu19 and may be a result of the K94R mutation. Therefore human residues at position 49, 71, 76, and 78 did not appear to affect Tau binding. The humanized samples demonstrated better binding to Tau than the mouse mAbs, but this was most likely due to the necessity of using different capture antibodies in this assay format.

TABLE 8

BIAcore™ analysis of mouse and humanized 7G6 Vh3/Vκ1 mAbs

| MAb | Species/Isotype | $k_a$ (×10$^5$ M$^{-1}$sec$^{-1}$) | $k_d$ (×10$^{-3}$ sec$^{-1}$) | $K_D$ (nM) |
| --- | --- | --- | --- | --- |
| 7G6-HCzu11-LCzu11 | human/IgG1 | 8.53 | 0.175 | 0.205 |
| 7G6-HCzu12-LCzu11 | human/IgG1 | 13.80 | 0.181 | 0.132 |
| 7G6-HCzu12-LCzu12 | human/IgG1 | 14.90 | 0.193 | 0.129 |
| 7G6-HCzu12-LCzu12 | human/IgG1 | 17.2 | 0.151 | 0.0875 |
| 7G6-HCzu13-LCzu12 | human/IgG1 | 14.2 | 0.239 | 0.168 |
| 7G6-HCzu14-LCzu12 | human/IgG1 | 14.6 | 0.194 | 0.133 |
| 7G6-HCzu15-LCzu12 | human/IgG1 | 20.2 | 0.278 | 0.138 |
| 7G6-HCzu16-LCzu12 | human/IgG1 | 15.3 | 0.174 | 0.114 |
| 7G6-HCzu17-LCzu12 | human/IgG1 | 17 | 0.124 | 0.073 |
| 7G6-HCzu18-LCzu12 | human/IgG1 | 15.7 | 0.128 | 0.0815 |
| 7G6-HCzu19-LCzu12 | human/IgG1 | 12.5 | 0.152 | 0.121 |
| 7G6-HCzu20-LCzu12 | human/IgG1 | 11.4 | 0.136 | 0.119 |
| 7G6-HCzu12-LCzu13 | human/IgG1 | 14 | 0.124 | 0.0888 |
| 7G6-HCzu12-LCzu14 | human/IgG1 | 17.3 | 0.119 | 0.0689 |
| 7G6-HCzu12-LCzu15 | human/IgG1 | 14.7 | 0.141 | 0.0959 |
| 7G6-HCzu12-LCzu16 | human/IgG1 | 14.9 | 0.148 | 0.099 |
| 7G6-HCzu12-LCzu17 | human/IgG1 | no binding | no binding | no binding |
| Hybridoma ms7G6 | mouse/IgG2b | 4.64 | 1.533 | 3.305 |
| recombinant ms7G6 | mouse/IgG2b | 3.73 | 1.556 | 4.170 |
| recombinant ms7G6 | mouse/IgG2a | 5.49 | 1.497 | 2.725 |

There was little difference between the $k_a$ or $k_d$ values for any 7G6 LC variant, except 7G6-LCzu17, which did not bind Tau due to Asn34. Therefore, the human Ile2 had no effect on antigen binding. Cysteine, serine, and tyrosine all appeared to be tolerated at position 57. A valine at position 30 had no impact on Tau binding.

10B.b.3 SDS-PAGE Analysis of HC/LC Stability for Vh3 and Vκ1 Variants

Figure 20A:
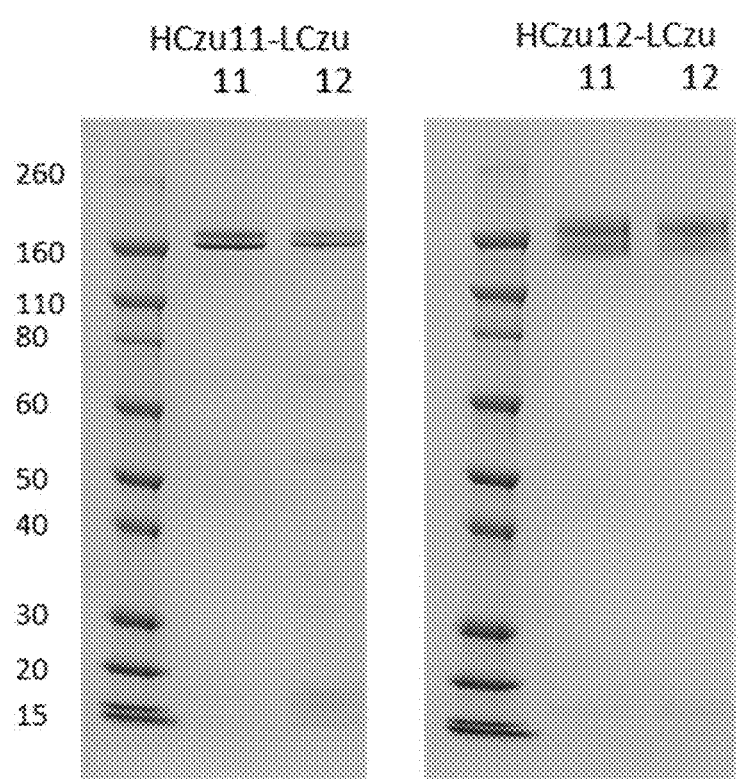

Two micrograms of each mAb were mixed with 4× NuPAGE™ LDS Sample Buffer and separated non-reduced on a 4-12% Bis-Tris SDS-PAGE gel in MOPS buffer. Gels were stained with InstantBlue and destained in water. The more human 7G6-HCzu11, especially when paired with the less human 7G6-LCzu12, resulted in HC-LC dimers and free HC (FIG. 20A). Further, 7G6-HCzu18 and 7G6-HCzu19 showed significant fragments (FIGS. 20B and 20C). These two antibodies differ from the others at position 71. Therefore, the human residue Arg41, while not impacting Tau binding, contributed to destabilization of the HC-LC interaction. All LC variants showed no antibody fragments. Contrary to Vh1-Vκ2 mAbs analyzed above, Cys49 did not produce HC—HC-LC trimers, HC—HC dimers, or free LC.

10B.c. Screening of Humanized Antibodies

Based on human-ness of the sequences, BIAcore™ affinity data and SDS-PAGE stability data from the IGHV1/IGKV2 humanization, 7G6-HCzu8 was chosen as the most human sequence with the highest affinity for Tau. 7G6-LCzu6 and 7G6-LCzu21 had comparable stability in SDS-PAGE and affinity for Tau but differed by one amino acid at position 36. Both light chains were chosen to be coexpressed with 7G6-HCzu8 to determine the best IGHV1/IGKV2-based mAb.

Another round of mutagenesis was performed on the most human, highest affinity, and most stable IGHV3 and IGKV1 variants to remove the unpaired cysteines at position 57 and 49, respectively. 7G6-HCzu17 and 7G6-HCzu18 were chosen as the most human framework residues with the highest affinity. 7G6-HCzu18 was super-humanized by introducing human residues into the C-terminal portion of CDRH2 to generate 7G6-HCzu21, but the affinity was never analyzed. 7G6-HCzu18, 7G6-HCzu21, and 7G6-HCzu17 all contained a cysteine at position 57, and a serine was introduced at position 57 in all three variants to generate 7G6-HCzu24, 7G6-HCzu23, and 7G6-HCzu25, respectively (FIG. 17). 7G6-LCzu14 and 7G6-LCzu15 were the most human Vκ sequences with the highest affinity. 7G6-LCzu14 retained Cys49 and was therefore mutated to remove the unpaired cysteine and was named 7G6-LCzu18. Each IGHV3 HC was paired with each IGKV1 LC.

10B.c.1 Intact Mass Analysis

The mass of each mAb was analyzed by ESI-MS to confirm the theoretical mass matched the observed mass. MAbs were digested with IdeS to generate F(ab')$_2$ fragments, followed by reduction with 2 mM DTT and heating at 60° C. for 3 min. The mass of the Fd (Vh-CH1) and LC fragments were analyzed by ESI-MS. 7G6-HCzu8 contained an N-terminal pyroglutamic acid, a typical post-translational modification of N-terminal glutamines. All observed masses were within 3 Daltons of the predicted masses (Table 9).

TABLE 9

ESI-MS analysis of humanized variants

|  | Fd | PyrQ | Cys | Calculated | Observed | dMass |
|---|---|---|---|---|---|---|
| 7G6-HCzu8-LCzu6 | 25447 | 17 | 4 | 25426 | 25425 | −1 |
| 7G6-HCzu8-LCzu21 | 25447 | 17 | 4 | 25426 | 25425 | −1 |
| 7G6-HCzu23-LCzu15 | 25349 |  | 4 | 25345 | 25345 | 0 |
| 7G6-HCzu24-LCzu15 | 25526 |  | 4 | 25522 | 25522 | 0 |
| 7G6-HCzu25-LCzu15 | 25469 |  | 4 | 25465 | 25463 | −2 |
| 7G6-HCzu23-LCzu18 | 25349 |  | 4 | 25345 | 25345 | 0 |
| 7G6-HCzu24-LCzu18 | 25526 |  | 4 | 25522 | 25521 | −1 |
| 7G6-HCzu25-LCzu18 | 25469 |  | 4 | 25465 | 25462 | −3 |

|  | LC | Cys | Calculated | Observed | dMass |
|---|---|---|---|---|---|
| 7G6-HCzu8-LCzu6 | 24007 | 4 | 24003 | 24003 | 0 |
| 7G6-HCzu8-LCzu21 | 23991 | 4 | 23987 | 23988 | 1 |
| 7G6-HCzu23-LCzu15 | 23953 | 4 | 23949 | 23949 | 0 |
| 7G6-HCzu24-LCzu15 | 23953 | 4 | 23949 | 23949 | 0 |
| 7G6-HCzu25-LCzu15 | 23953 | 4 | 23949 | 23948 | −1 |
| 7G6-HCzu23-LCzu18 | 23967 | 4 | 23963 | 23963 | 0 |
| 7G6-HCzu24-LCzu18 | 23967 | 4 | 23963 | 23963 | 0 |

10B.c.2 Tau Binding BIAcore™ Assay

Tau binding for humanized mAbs was analyzed by BIAcore™ in two different formats. The first format was performed as above, i.e. mAbs were captured with an immobilized species-specific anti-Fc antibody. The limitation of this format is seen in Tables 5 and 8 where the affinities of the parental mouse and humanized mAbs cannot be directly compared due to the differences in the capture antibodies. In the second format, biotinylated mAbs were captured on a streptavidin-coated chip. This latter format allowed direct comparison of Tau binding affinity between humanized and the parental mouse antibody since the capture method was identical.

10B.c.2.i Fc-Specific Capture

The final humanized mAbs were analyzed by BIAcore™ to determine the $k_a$, $k_d$, and $K_D$ for binding to Tau as above (Table 10). There was a significant change in the off rate ($k_d$) from 7G6-HCzu23 to 7G6-HCzu24, while 7G6-HCzu24 was similar to 7G6-HCzu25, which was also seen in the overall affinity $K_D$ as well. This confirmed the importance of retaining mouse residues in CDRH2, as seen above in Table 7.

TABLE 10

BIAcore ™ analysis of humanized 7G6 mAbs binding monomeric Tau (anti-human capture)

| MAb | $k_a$ (×10$^5$ M$^{-1}$sec$^{-1}$) | $k_d$ (×10$^{-3}$ sec$^{-1}$) | $K_D$ (nM) |
|---|---|---|---|
| 7G6-HCzu8-LCzu6 | 14.9 | 0.22 | 0.15 |
| 7G6-HCzu23-LCzu15 | 16.1 | 0.39 | 0.25 |
| 7G6-HCzu24-LCzu15 | 8.09 | 0.11 | 0.13 |
| 7G6-HCzu25-LCzu15 | 9.85 | 0.13 | 0.13 |
| 7G6-HCzu23-LCzu18 | 17.1 | 0.37 | 0.22 |
| 7G6-HCzu24-LCzu18 | 9.48 | 0.09 | 0.09 |
| 7G6-HCzu25-LCzu18 | 11.1 | 0.14 | 0.13 |

10B.c.2.ii Streptavidin Capture

Biotinylated humanized and mouse mAbs were captured on a streptavidin-coated chip and $k_a$, $k_d$, and $K_D$ were determined for binding to Tau (Table 11). 7G6-HCzu8-LCzu21 showed a slight drop in affinity (<2-fold) compared with 7G6-HCzu8-LCzu6. Similarly, 7G6-HCzu23 variants had an ~2-fold drop in affinity compared to 7G6-HCzu24 and 7G6-HCzu25 mAbs, as seen in Table 11. The affinity of 7G6-HCzu8-LCzu6, 7G6-HCzu24-LCzu15, 7G6-HCzu24-LCzu18, 7G6-HCzu25-LCzu15, and 7G6-HCzu25-LCzu18 were all similar. Overall, these antibodies showed an ~1.4-fold drop in affinity compared with the ms7G6, reflected mainly in a slightly faster off-rate for the humanized forms.

TABLE 11

BIAcore ™ analysis of humanized 7G6 mAbs and mouse 7G6 binding monomeric Tau (streptavidin capture)

| MAb | $k_a$ (×10$^5$ M$^{-1}$sec$^{-1}$) | $k_d$ (×10$^{-3}$ sec$^{-1}$) | $K_D$ (nM) |
|---|---|---|---|
| 7G6-HCzu8-LCzu6 | 28.20 | 0.258 | 0.0915 |
| 7G6-HCzu8-LCzu21 | 22.80 | 0.313 | 0.1380 |
| 7G6-HCzu23-LCzu15 | 21.80 | 0.332 | 0.1520 |
| 7G6-HCzu23-LCzu18 | 21.40 | 0.390 | 0.1820 |
| 7G6-HCzu24-LCzu15 | 54.20 | 0.487 | 0.0898 |
| 7G6-HCzu24-LCzu18 | 38.10 | 0.304 | 0.0797 |
| 7G6-HCzu25-LCzu15 | 27.10 | 0.270 | 0.0998 |
| 7G6-HCzu25-LCzu18 | 35.00 | 0.307 | 0.0881 |
| ms7G6 | 31.10 | 0.195 | 0.0636 |

10B.c.3 Analysis of Homogeneity and Aggregation by SEC-HPLC

Figure 21A:
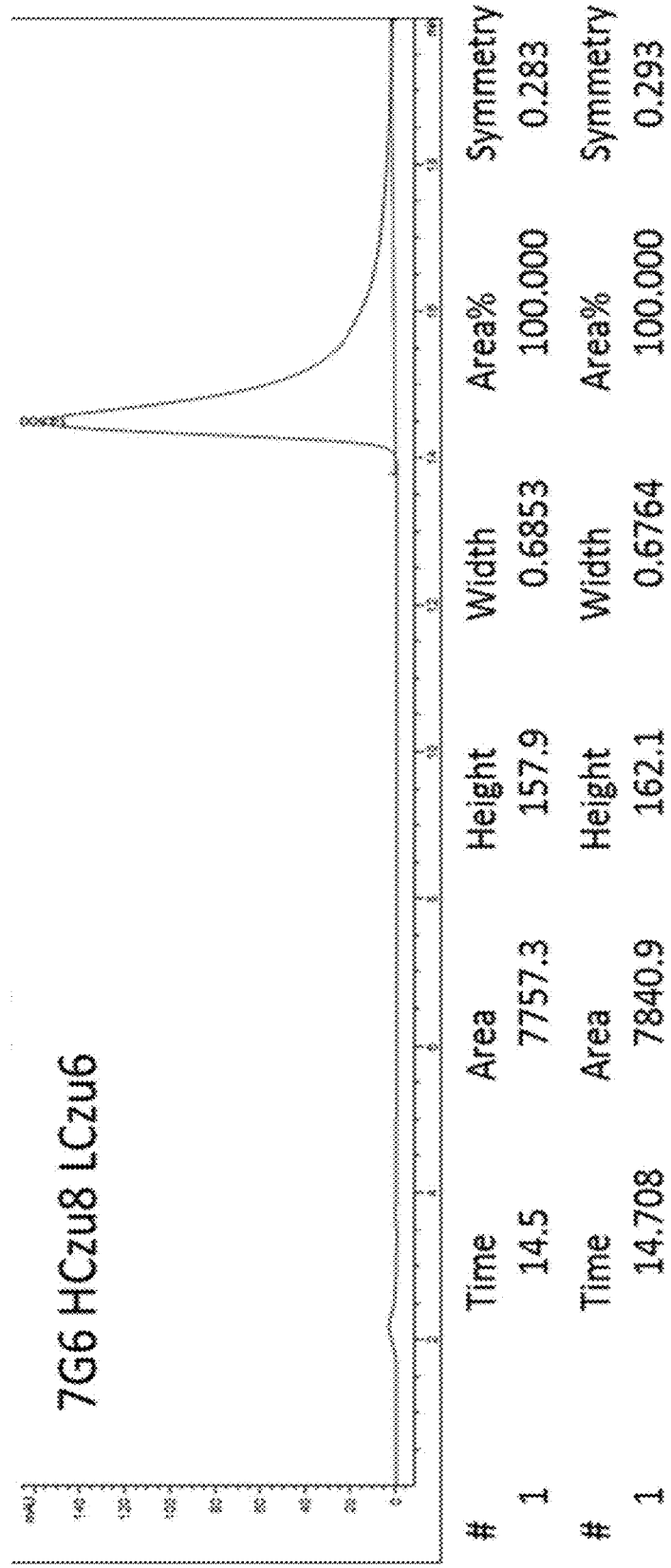
FIGS. 21A and 21B illustrate the results of SEC-HPLC analysis to assess the homogeneity of antibody 7G6 humanized variants 7G6-HCzu8-LCzu6 (FIG. 21A) and 7G6-HCzu25-LCzu18 (FIG. 21B) in solution. Five micrograms of mAb 7G6 humanized variant were injected into an Agilent 1260 Infinity with an AdvanceBio SEC 300A 2.7 um 4.6×50 Guard column, and AdvanceBio SEC 300A 2.7 um 4.6×300 mm column. Samples were analyzed in 0.1M sodium phosphate buffer, pH 6.5 at a flow rate of 0.35 mL/min, and the absorbance at 280 nm was analyzed. Representative data for mAb 7G6-HCzu8-LCzu6 or 7G6-HCzu25-LCzu18 are shown.
Figure 21B:
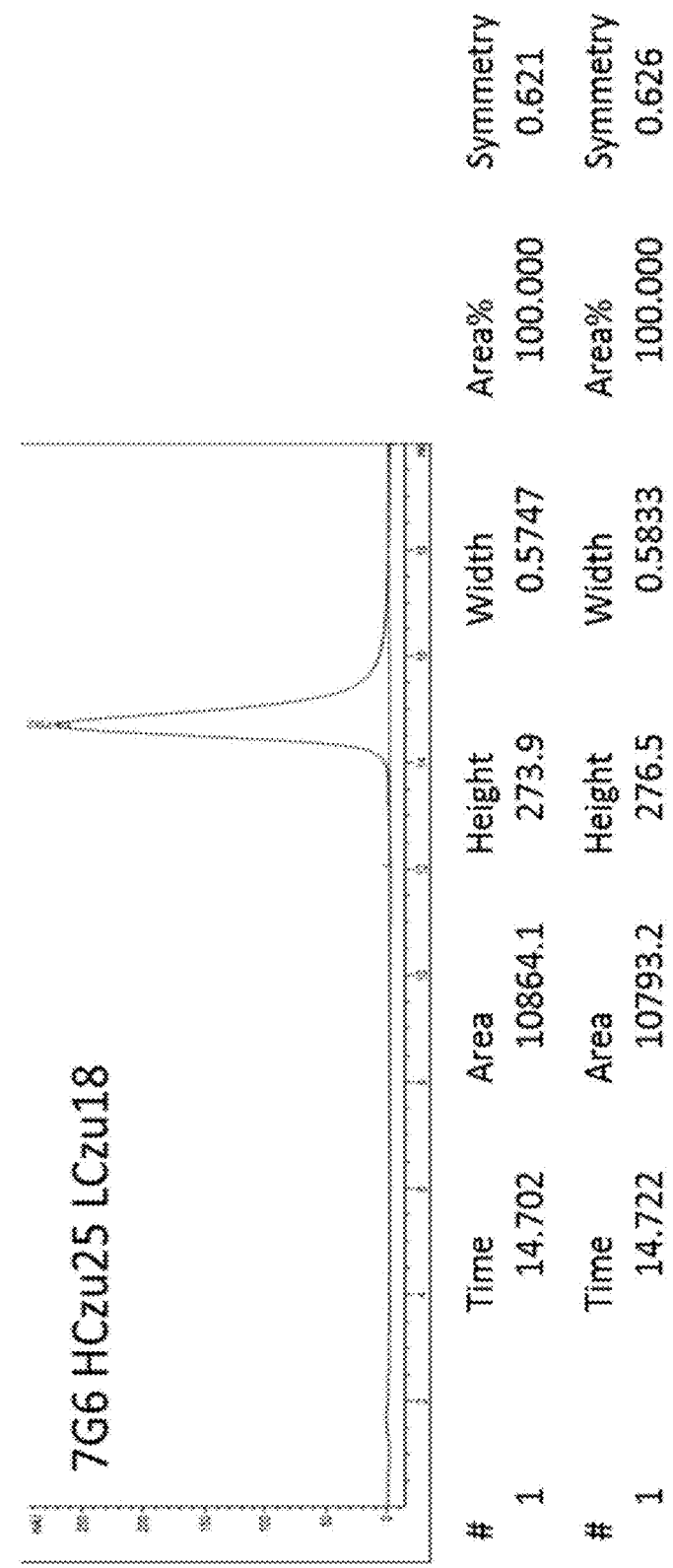
Figure 22A:
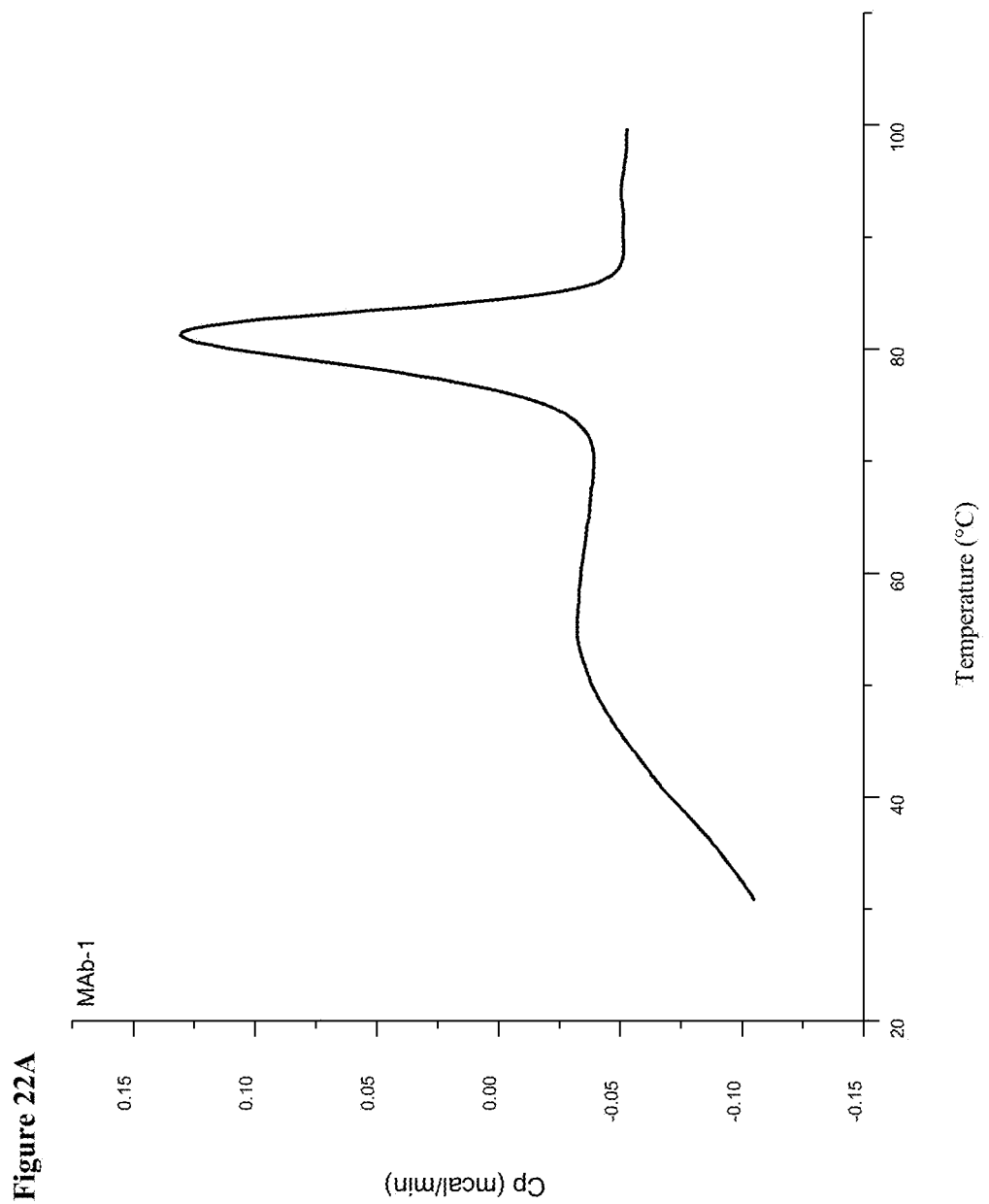
FIGS. 22A-L illustrate the thermal melting curves of F(ab')$_2$ fragments that were analyzed by differential scanning calorimetry (DSC).
Figure 22B:
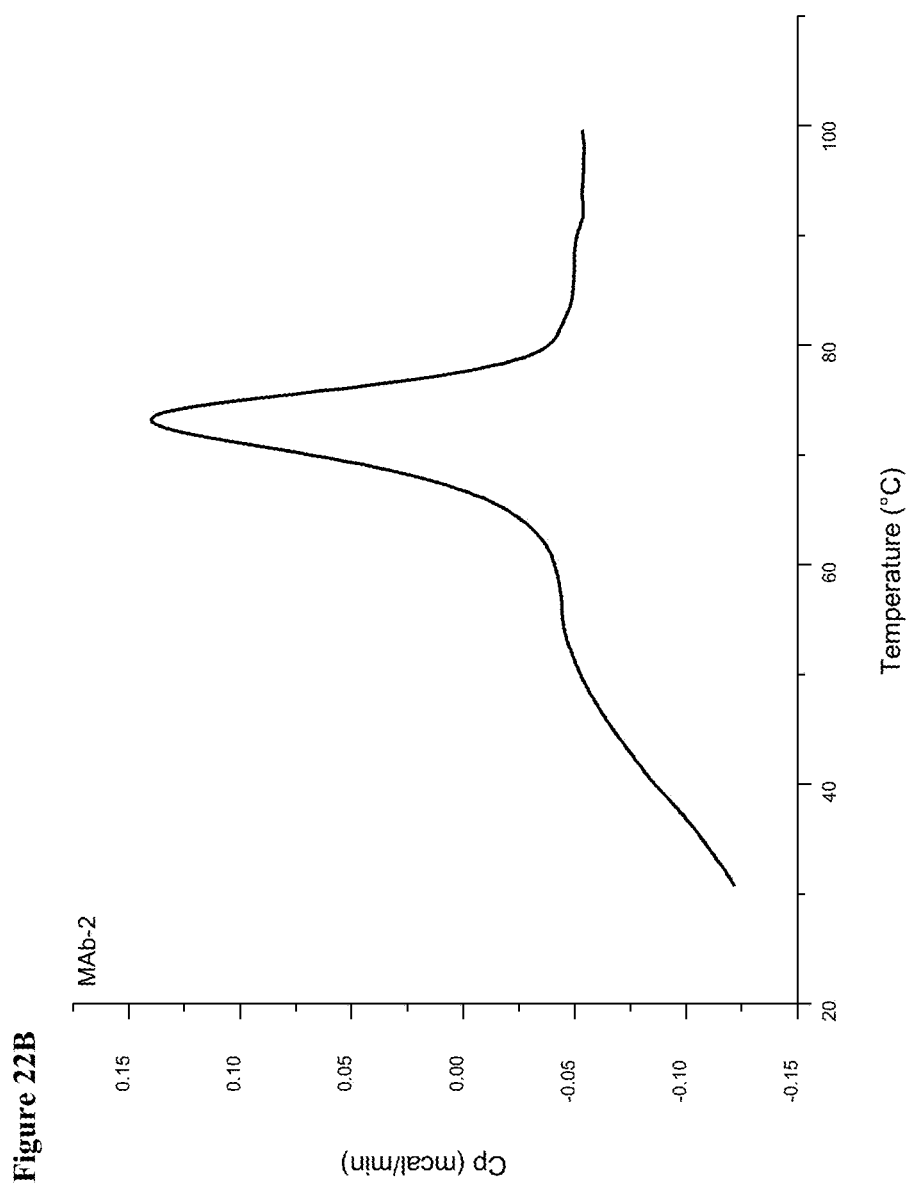
Figure 22C:
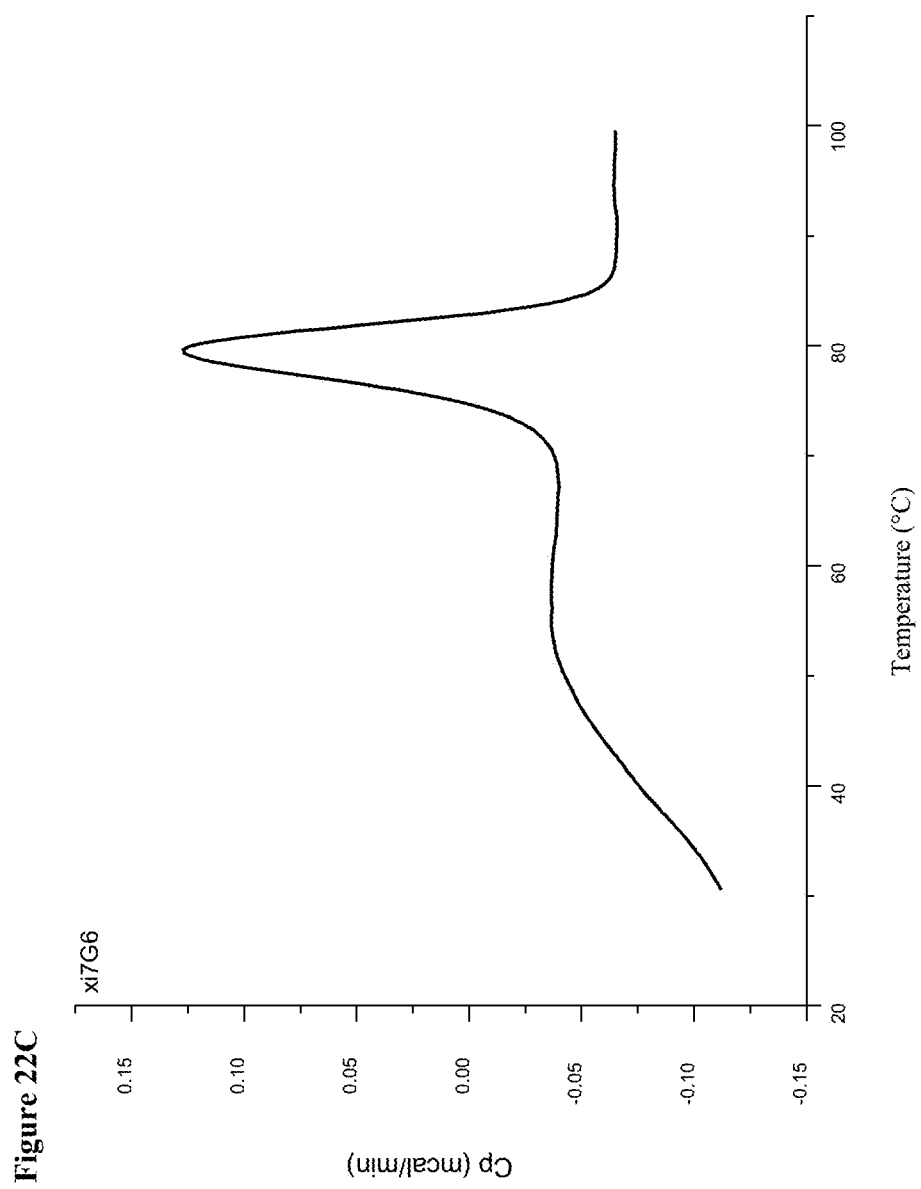
Figure 22D:
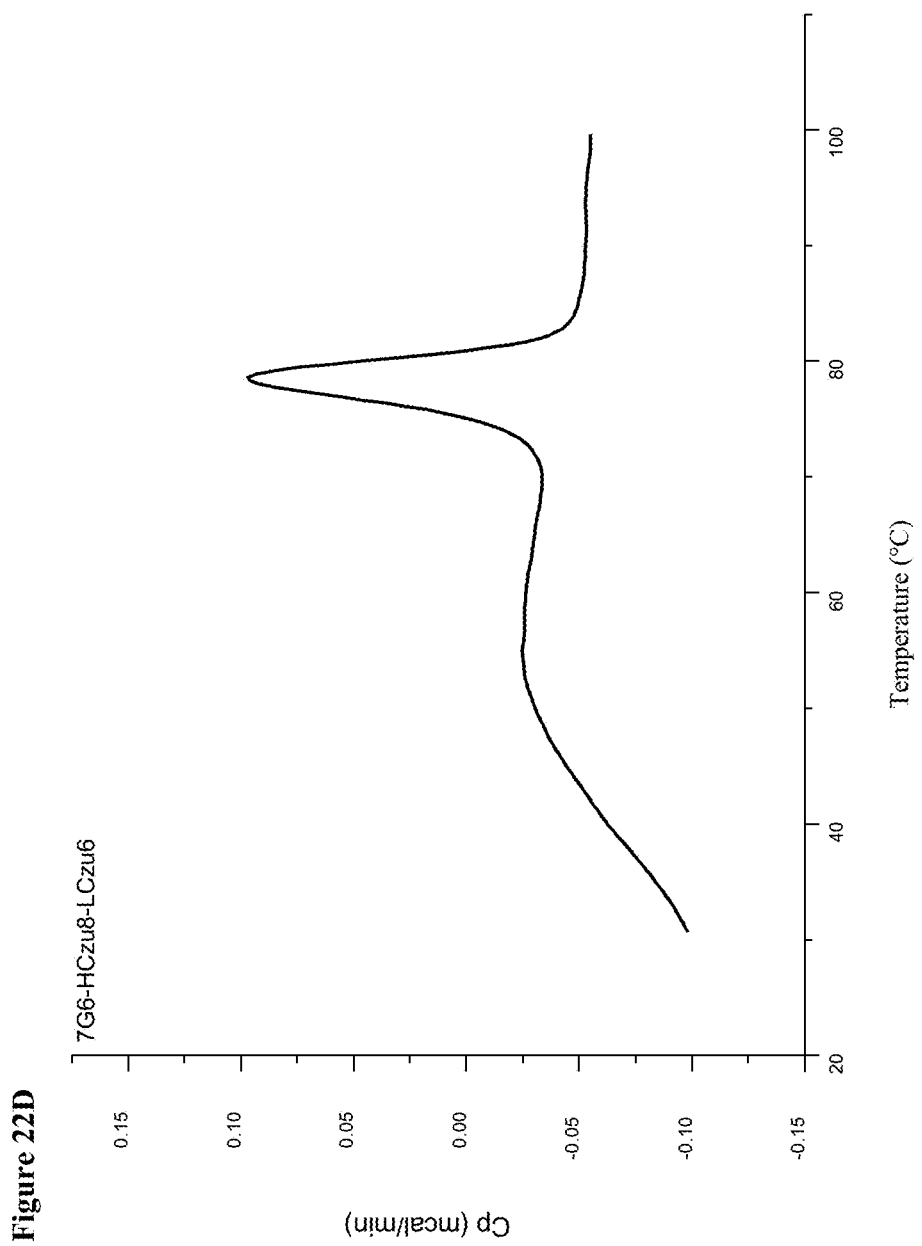
Figure 22E:
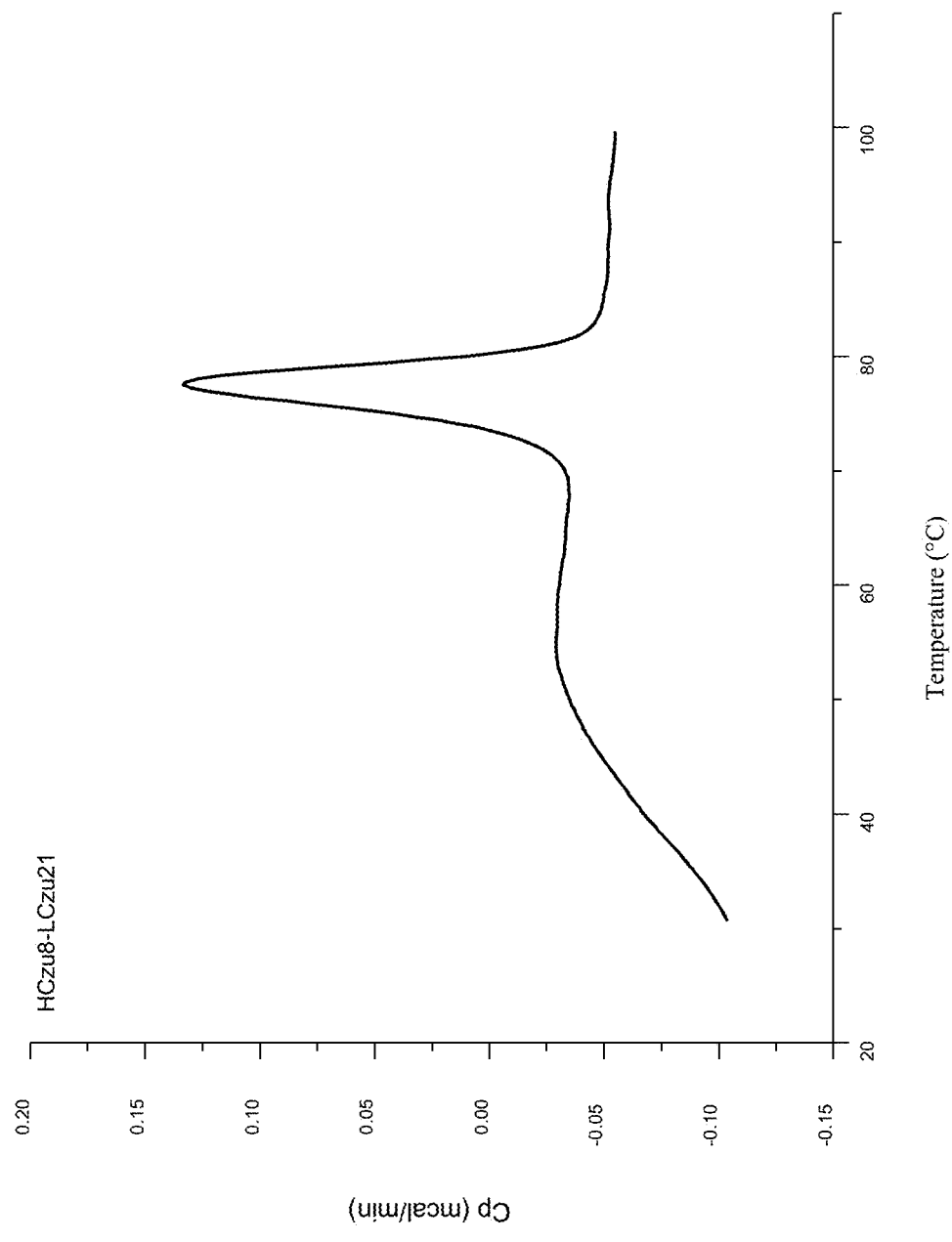
Figure 22F:
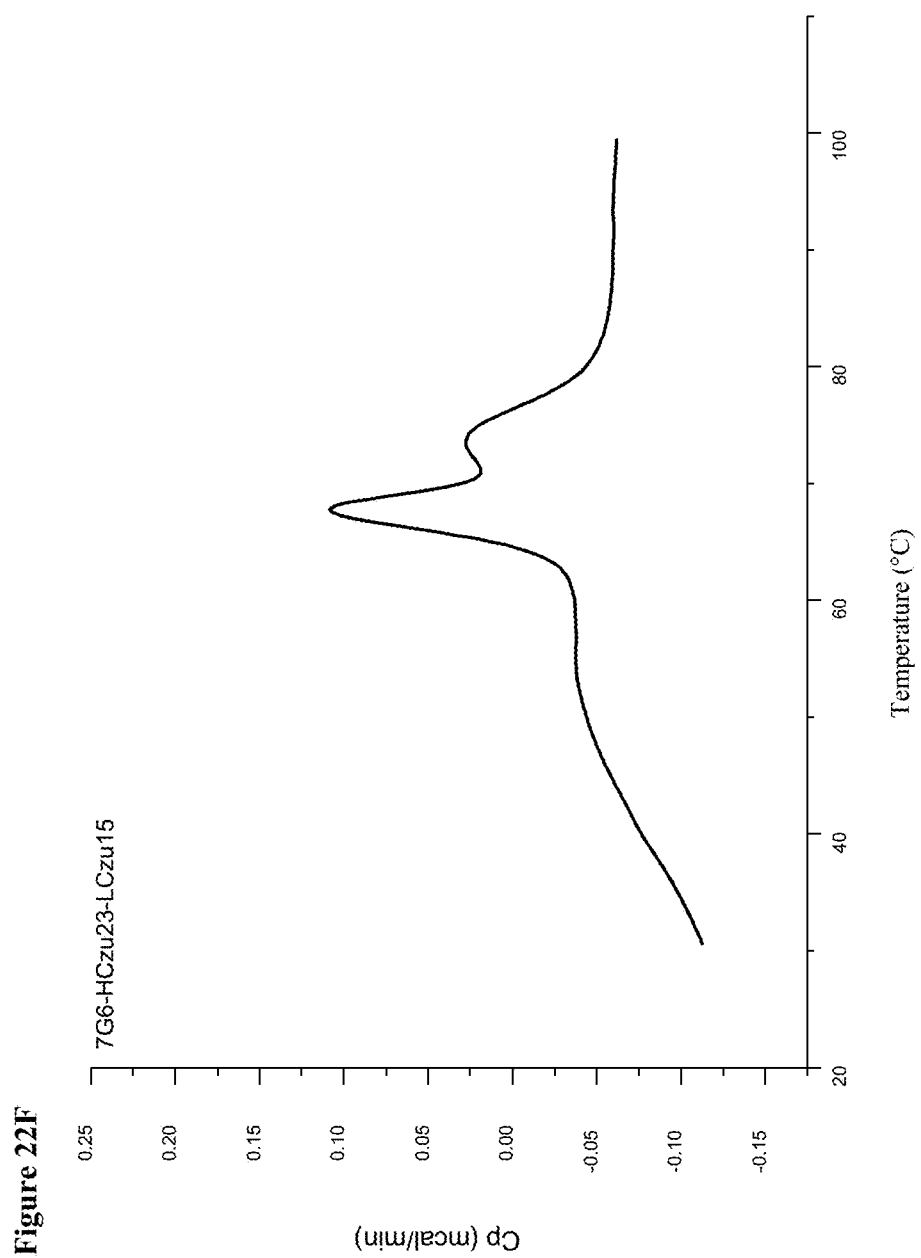
Figure 22G:
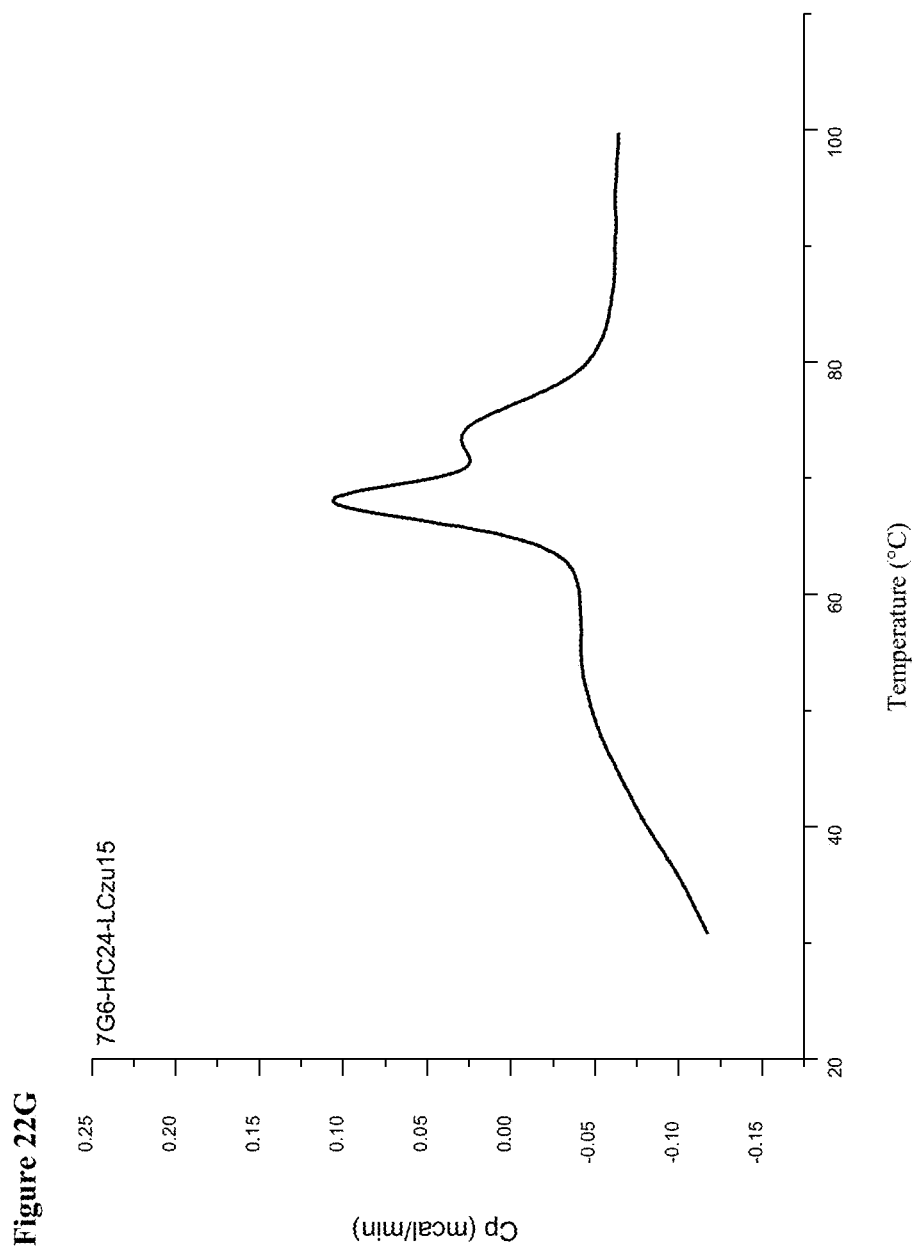
Figure 22H:
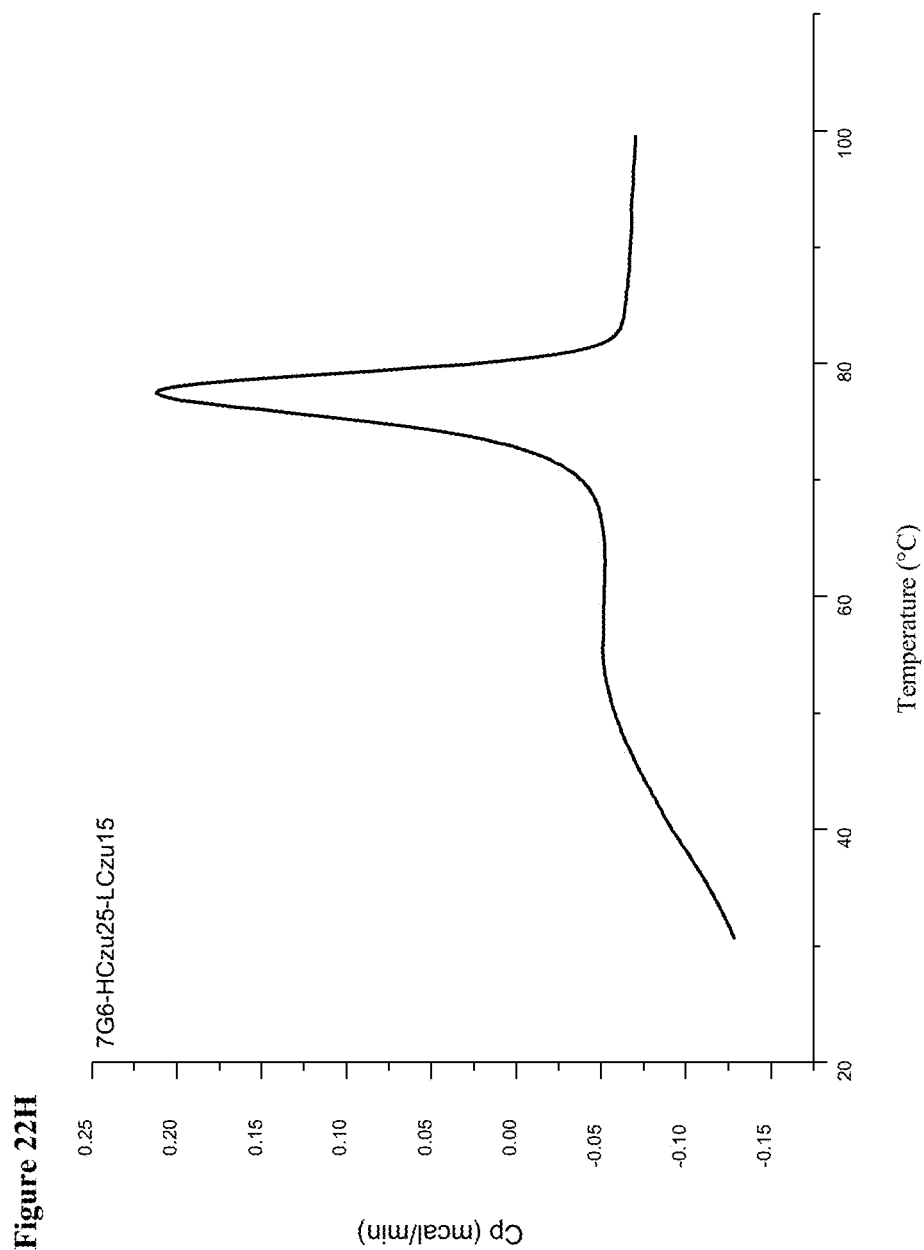
Figure 22I:
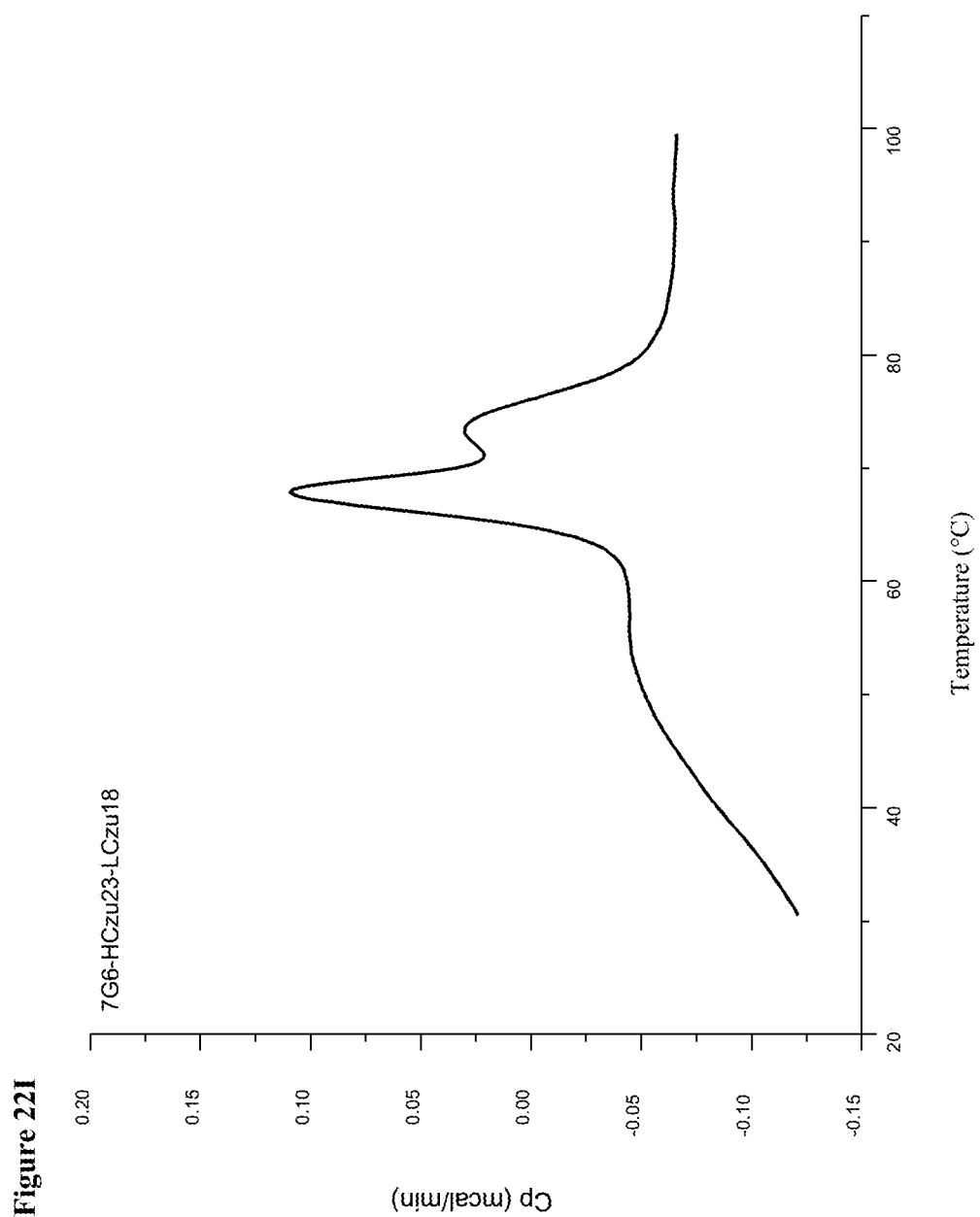
Figure 22J:
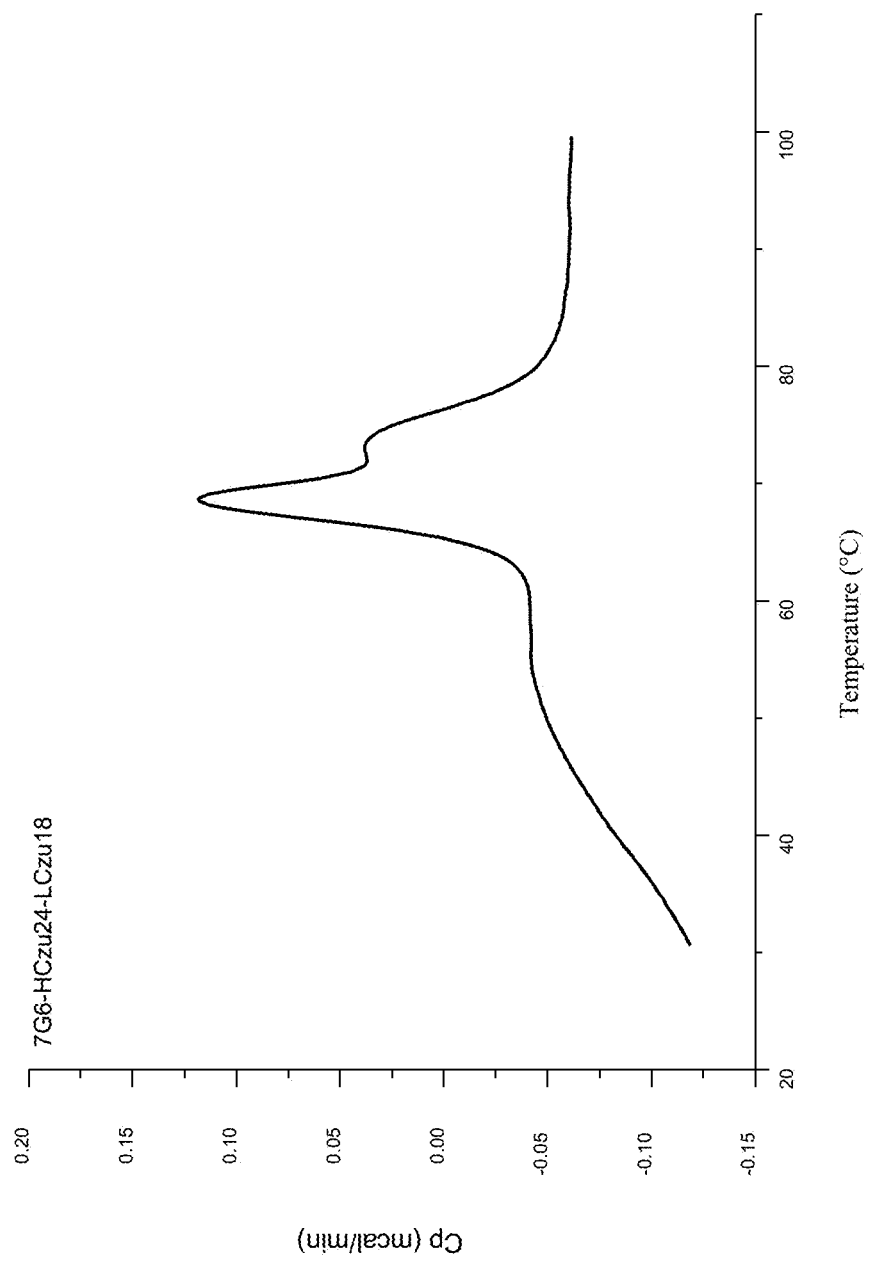
Figure 22K:
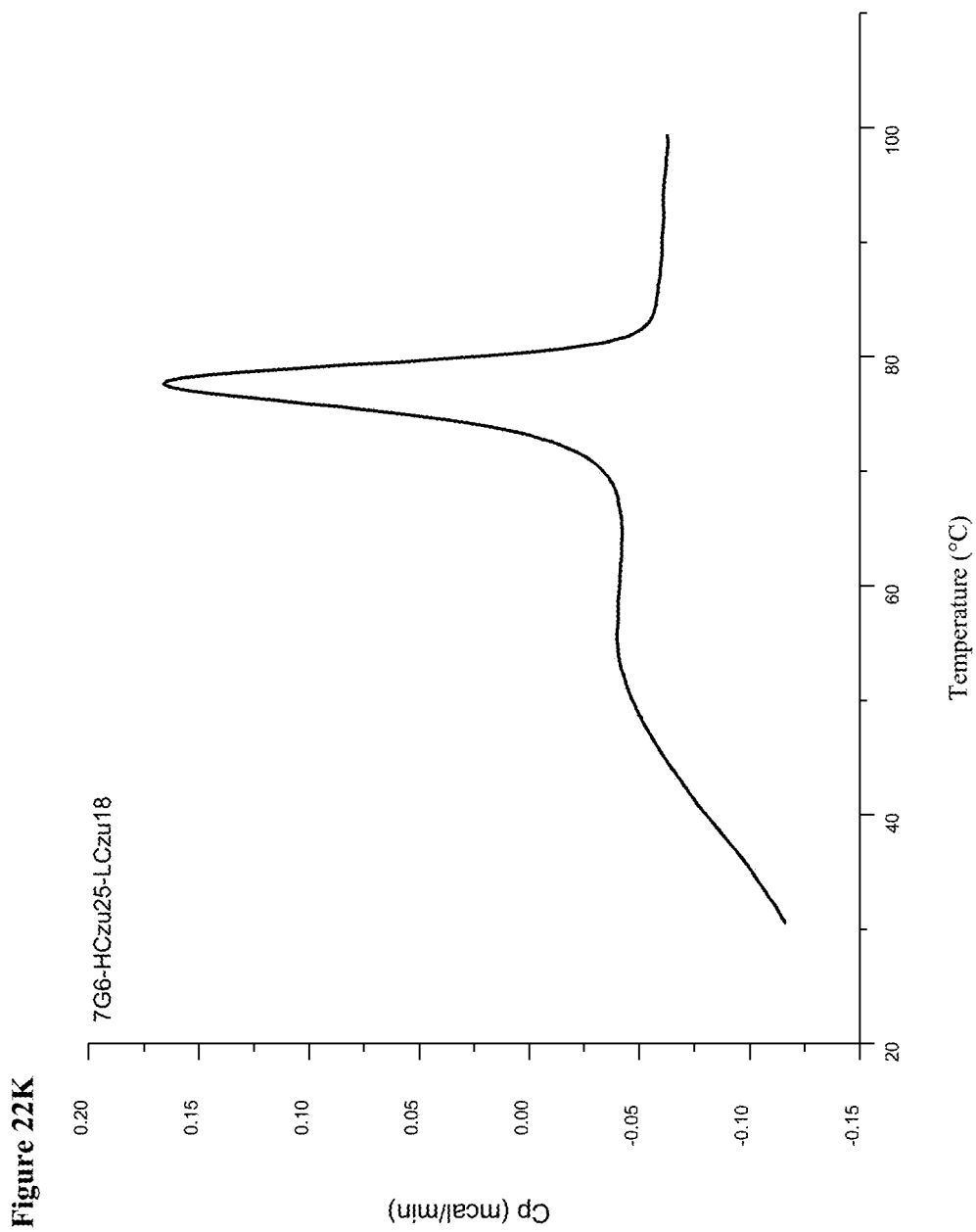
Figure 22L:
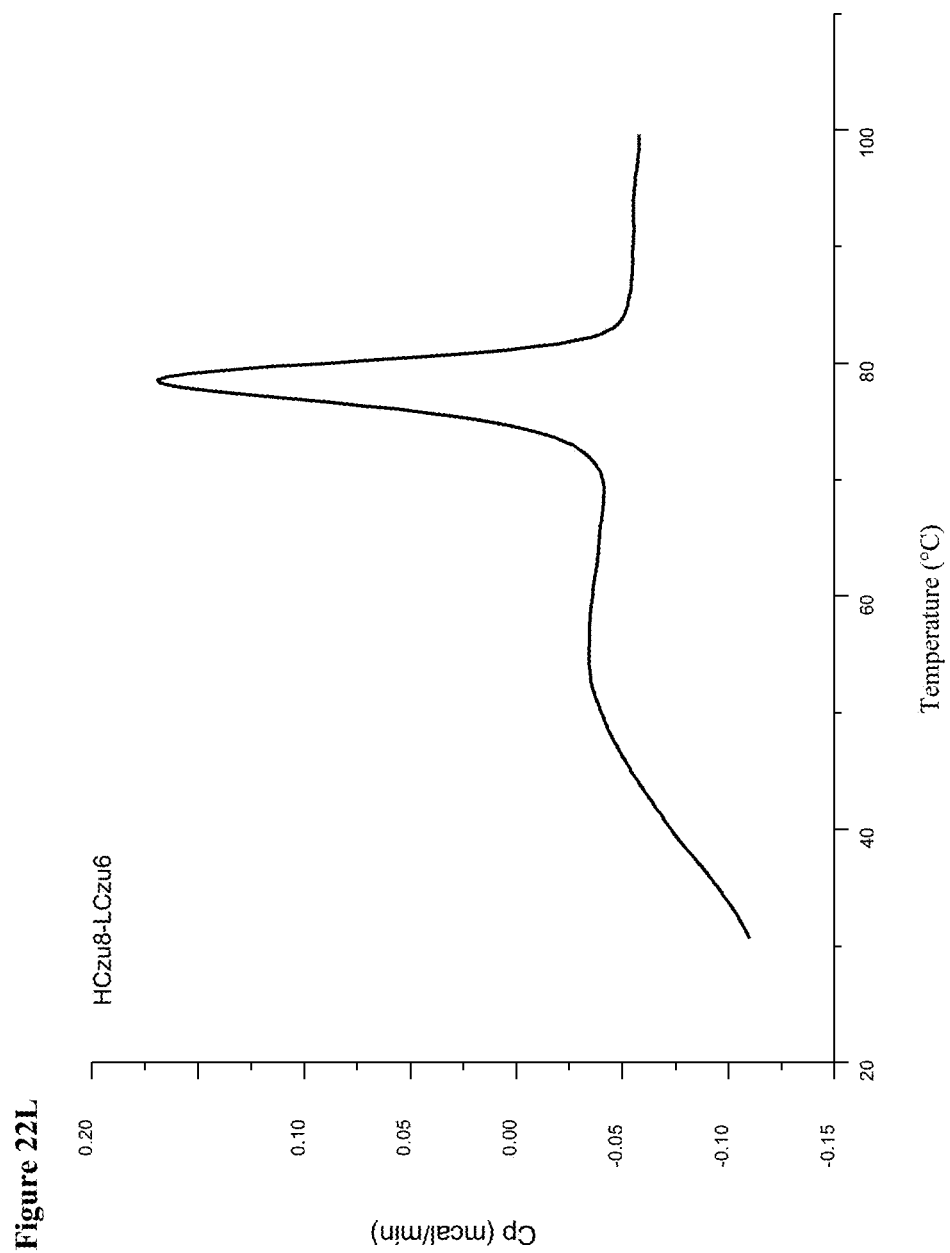

Each mAb was analyzed by SEC-HPLC to determine the homogeneity of the mAb in solution. The profiles of 7G6-HCzu8-LCzu6 and 7G6-HCzu8-LCzu21 mAbs were identical, with a main peak at 14.5 min and wide shoulder suggesting possible product heterogeneity beyond 16 minutes (FIG. 21A). The profiles of 7G6-HCzu23, 7G6-HCzu24, and 7G6-HCzu25 mAbs were identical, with a tight peak around 14.7 min (FIG. 21B).

10B.c.4 DSC Analysis

The thermal melting curves of F(ab')$_2$ fragments were analyzed by differential scanning calorimetry (DSC). The profiles of the chimeric, 7G6-HCzu8 and 7G6-HCzu25 F(ab')2 were similar to control non-Tau binding human IgG1 antibodies, mAb1 and mAb2. 7G6-HCzu23 and 7G6-HCzu24, however, contained a second peak, indicating instability of the F(ab')2 fragment, possibly the dissociation of the HC-LC interaction (FIGS. 22A-L). The transition midpoints of 7G6-HCzu8-LCzu21, 7G6-HCzu25-LCzu15, and 7G6-HCzu25-LCzu18 were similar, ranging from 77.4 to 77.6° C. The midpoint of 7G6-HCzu8-LCzu6 was one degree higher at 78.6° C. (Table 12).

TABLE 12

Melting transition midpoints of humanized 7G6 F(ab')2 fragments

| | Transition Midpoint-1 | Transition Midpoint-2 |
|---|---|---|
| Analysis 1 | | |
| 7G6-HCzu8-LCzu6 | N/A | 78.61 |
| 7G6-HCzu23-LCzu15 | 67.81 | 73.41 |
| 7G6-HCzu24-LCzu15 | 68.04 | 73.38 |
| 7G6-HCzu25-LCzu15 | N/A | 77.42 |
| 7G6-HCzu23-LCzu18 | 67.81 | 73.41 |
| 7G6-HCzu24-LCzu18 | 68.78 | 73.26 |
| 7G6-HCzu25-LCzu18 | N/A | 77.6 |
| Analysis 2 | | |
| 7G6-HCzu8-LCzu6 | N/A | 78.58 |
| 7G6-HCzu8-LCzu21 | N/A | 77.51 |

10B.d T Cell Epitope Analysis

Humanized sequences were analyzed in silico by Stealth Biologics for potential immunoreactive T cell epitopes. Two sequences for each variable region germline family were analyzed, each contained differing amounts of human and mouse residues. mAb1-2a and mAb1-2b represented IGHV1-46a/IGKV2-30a and mAb3-1a and mAb3-1b represented IGHV3-23b/IGKV1-39b. Though only four sequences were analyzed for each variable domain, all potential T cell epitopes present in the tested humanized mAbs were represented. Peptide epitopes having identity to greater than 5% of human germline sequences were considered lower risk, as were peptides binding only one or two HLA alleles.

FIGS. 23 and 24 summarize the analysis of epitopes present in the mAbs. The peptides in the tables were identified as having 5% or less identity to human germline sequences. The percent homology of the peptides to variable domain germline sequences was also taken into consideration. Peptides with ~5% or less homology to variable region germline sequences and/or were predicted to bind three or more HLA alleles were identified as higher risk (highlighted in gray).

7G6-HCzu8 and 7G6-HCzu25 both contained a common low-risk peptide at position 32 with no homology to germline sequences that bound 3 alleles (FIGS. 23A and 23B). Peptide 2 was predicted to be a low risk in 7G6-HCzu25, but the 7G6-HCzu8 peptide 2 was not. Peptide 64 was present as a risk in both HCs, predictively binding 3 alleles. The peptide sequence in 7G6-HCzu8 may present less of a risk as it has some homology to germline variable domains. Peptide 70 in 7G6-HCzu8, but not 7G6-HCzu25, posed a slight risk.

There was one difference between 7G6-LCzu6 and 7G6-LCzu21 where peptide 38 in 7G6-LCzu21 was predicted to bind 1 HLA allele but presented a very low risk (FIGS. 24A-24D). Between 7G6-LCzu15 and 7G6-LCzu18 there was only one difference with peptide 2 that posed a higher risk in 7G6-LCzu15 than 7G6-LCzu18 as there was little to no homology to variable domain germline sequences. Comparing 7G6-LCzu6/7G6-LCzu21 with 7G6-LCzu15/7G6-LCzu18, 7G6-LCzu6/7G6-LCzu21 sequences contained 9 potentially immunogenic peptides while 7G6-LCzu15/7G6-LCzu18 contained 6. Peptides 51 and 52 were the same between all LCs and peptides 88-94 were the same or similar, with the exception being peptide 90 present in 7G6-LCzu6/7G6-LCzu21 that was not present in 7G6-LCzu15/7G6-LCzu18. Peptides 2 and 3 were riskier in 7G6-LCzu6/7G6-LCzu21 than in 7G6-LCzu15/7G6-LCzu18.

10C. Summary

In summary, ms7G6 was humanized on two different human germline variable domain families with similar affinity to ms7G6.

The human germlines closest to the mouse sequence were IGHV1-46 and IGKV2-30. Even though several mouse framework residues were suspected to be required to maintain antigen binding, Tau binding was not affected by human framework residue (7G6-HCzu1/7G6-HCzu8). Further, Tau binding was not affected by mutation of the unpaired Cys57 to a serine (7G6-HCzu5/7G6-HCzu8) or super-humanization of CDRH2 at residues 60, 61, 64, and 65 (7G6-HCzu4/7G6-HCzu8). Grafting the Vκ CDRs on the IGKV2 did not result in a dramatic decrease in Tau binding, but the addition of one or two mouse framework residues stabilized the HC-LC interaction. Leu46 with or without Tyr36 increased the stability of Vh-Vκ interaction, as analyzed by SDS-PAGE, and the Tyr36-Leu46 (7G6-LCzu2/7G6-LCzu6) combination resulted in an antibody with slightly higher affinity to Tau than with Leu46 or Tyr36 alone (7G6-LCzu/7G6-LCzu21 and 7G6-LCzu4/7G6-LCzu22, respectively). Though there was a slight risk in immunogenicity with a leucine at position 46, the risk was low. The unpaired Cys49 could be substituted with a serine, but a tyrosine substitution resulted in an increase in the dissociation rate.

The human germline variable domain families IGHV3-23 and IGKV1-39 were chosen to potentially reduce the immunogenicity of the humanized mAb by utilizing the more commonly expressed IGHV3 and IGKV1 families. Grafting CDRs onto the IGHV3 germline required one or more mouse residues. Arg94 could not be the human lysine residue. Mouse residues at positions 60, 61, 62, 63, and 65 were required for optimal antigen binding. An arginine at 71 did not affect antigen binding but was required for stability of the Vh-Vκ interaction (7G6-HCzu12, 7G6-HCzu13, 7G6-HCzu14, 7G6-HCzu15, 7G6-HCzu16, 7G6-HCzu17, 7G6-HCzu25). Although Val71 resulted in a potentially immunogenic peptide when paired with Phe63 and Ser65, the risk was low. Tau binding was not affected by mutation of the unpaired Cys57 to a serine (7G6-HCzu23, 7G6-HCzu24, 7G6-HCzu25). Human residues throughout the IGKV1 framework did not affect antigen binding or stability (7G6-LCzu18).

For all antibodies tested, there were little differences in the pI and thermal stability.

Example 11: Immunohistochemistry with 7G6-HCzu25/LCzu18 on Human Disease Brain

Paraffin-embedded, fixed human brain sections (8 μm) were dewaxed with multiple changes of xylene and then washed throroughly in 100% Industrial Methylated Spirit (IMS). Sections were placed into hydrogen peroxide ($H_2O_2$) and methanol (2 mL hydrogen peroxide per 100 mL methanol) for 10 minutes at room temperature to block endogenous peroxidase and then washed under running tap water for a further 10 minutes. Each section was then treated with 98% formic acid for 10 minutes at room temperature followed by washing in running tap water for another 10 minutes. Sections were then cooked in citrate buffer (pH 6.0) for 10 minutes at pressure and then washed again in running tap water followed by TBS. After a rinse in de-ionized water, each slide was carefully removed and dried around the tissue edge. Once dry, a wax pen was used to mark around the section before applying a Proteinase K solution for 10 minutes at room temperature.

Figure 25:
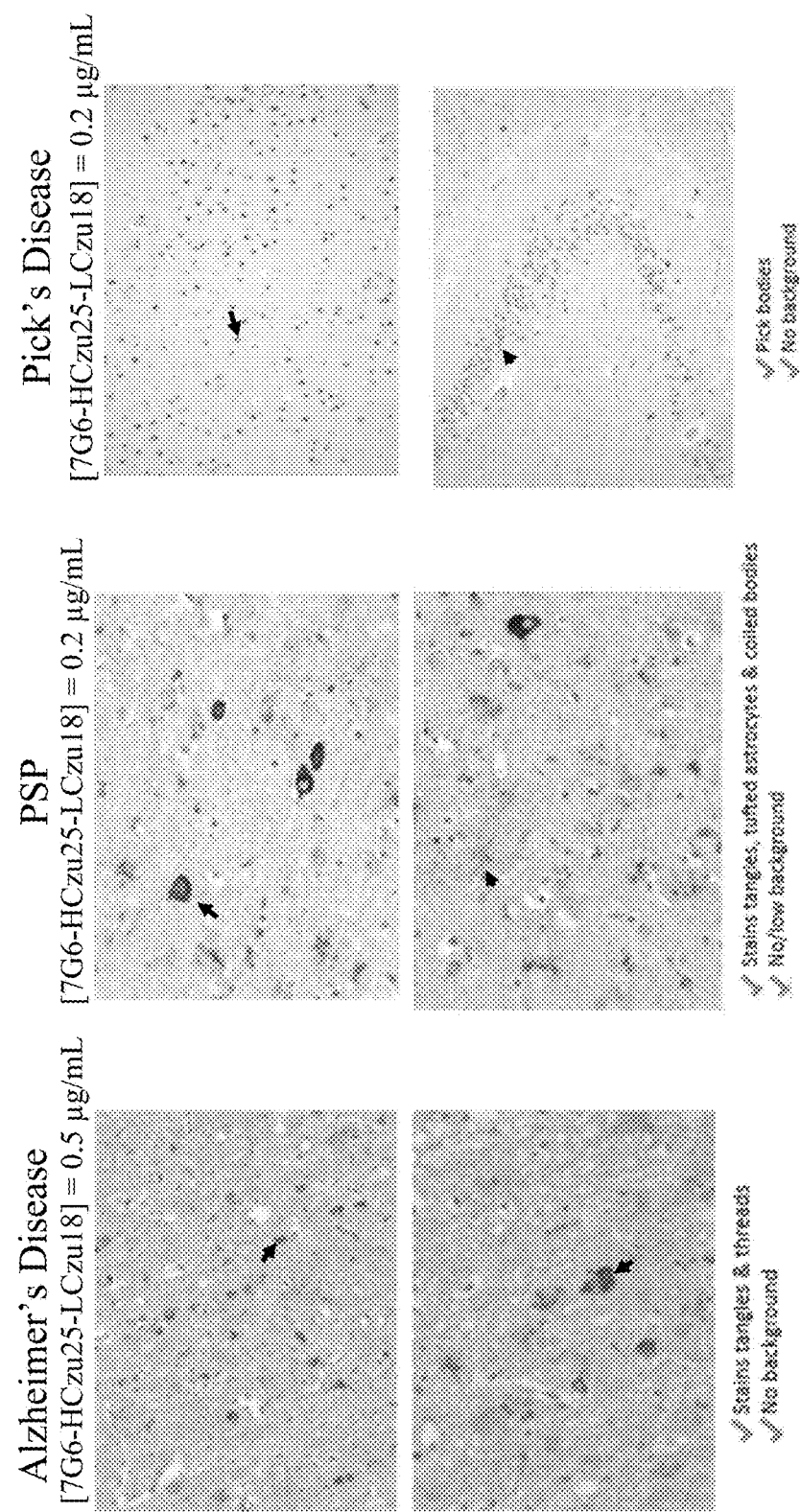
FIG. 25 shows images of immunohistochemical staining of AD, PSP, and PiD tissue samples with antibody 7G6-HCzu25-LCzu18. Antibody 7G6-HCzu25-LCzu18 strongly and specifically recognizes pathological Tau (depicted by black arrows in each image) in human post-mortem diseased brain.

Once tissue sections were prepared, staining with the 7G6-HCzu25-LCzu18 antibody at different concentrations was carried out with the Klear Human HRP-Polymer DAB Detection Kit (GBI Labs, Bothwell, Wash.; Cat No. D103-18) as per the manufacturer's instructions. As shown in FIG. 25, antibody 7G6-HCzu25-LCzu18 strongly and specifically recognizes pathological Tau in brains from Alzheimer's disease (neurofibrillary tangles and neuropil threads), PSP (tangles, tufted astrocytes and coiled bodies) and Pick's disease (Pick bodies) by immunohistochemistry. The antibody also showed only a very low level of background staining in all tissues tested.

Example 12: Affinity of 7G6-HCzu25-LCzu18 to 2N4R Wild Type Tau

12A. Materials & Methods
12A.c.2. CHO Transient mAb Production

7G6-HCzu25-LCzu18 antibody was produced using the Lonza version 7 platform according to the manufacturer's procedures. DNA fragments encoding 7G6-HCzu25 and 7G6-LCzu18 were cloned into an expression plasmid encoding glutamine synthase from Lonza. According to Lonza's protocol for selecting MSX-resistant cell lines, CHO-Klsv cells were electroporated with the 7G6-HCzu25-LCzu18 expression plasmid, followed by seeding 2500 cells per well in 96-well plates in glutamine-free medium in the presence of 25 or 50 μM MSX. Wells containing MSX-resistant cell were subjected to several rounds of screening for antibody expression at various cell culture volumes. The cell line 96E7 producing the highest 7G6-HCzu25-LCzu18 antibody titers was chosen for further development and frozen at −80° C. and stored in vapor phase in liquid nitrogen.

A vial of cell line 96E7 was thawed and cultivated in disposable shake flasks at 36.5° C. and 5% $CO_2$ followed by further expansion every 3-4 days in larger-sized disposable rocking bags at 36.5° C. and 5% $CO_2$. A 200 L stainless steel seed bioreactor was employed to final expansion at 36.5° C. with controlled pH and dissolved oxygen prior to the inoculation of a 1000 L stainless steel fed-batch production bioreactor. After 15 days at fed-batch mode and 36.5° C. with controlled pH and dissolved oxygen, the supernatant was harvested through depth filtration.

12A.d. MAb Purification

Purification was performed using an AKTAprocess purification platform (GE Healthcare). The purification process consisted of the following steps: Protein A capture chromatography, viral inactivation, depth filtration, anion-exchange flow through chromatography, viral reduction filtration, concentration and final buffer exchange.

The primary capture step was performed using Amsphere A3 Protein A resin (JSR). The 14.1 L column was equilibrated using 50 mM sodium phosphate, 1 M NaCl, pH 7.0 then loaded up to 45 g protein per liter of resin per cycle. After loading, the column was washed with equilibration buffer followed by 25 mM Bis-Tris, pH 7.0 until UV returned to baseline. Bound material was eluted from the column using 100 mM Glycine, pH 3.4. The pH of the eluate was adjusted to pH 3.6 using 2 M Acetic Acid for low pH viral inactivation. Following a minimum 30 minute static hold, the eluate was neutralized to pH 6.8 using 2 M Tris Base. Depth filtration was immediately performed using Millistak+ DOHC and XOHC pod filters (Millipore). The filtrate was further processed using a 6.7 L Capto Q (GE Healthcare) anion exchange column equilibrated in 25 mM Bis-Tris, pH 7.0. The column was loaded up to 150 g protein per liter of resin in non-binding mode. The flow-through product was filtered using a Viresolve Pro viral reduction filter then concentrated to 25 g/L. The material was buffer exchanged into a buffer. The purification procedure was performed on two different monoclonal antibody production runs and designated lots 17-0190 and 18-0146. Several vials from lot 17-0190 were designated 17-0190ARS for use as a reference standard.

12A.f. Surface Plasmon Resonance (SPR) Binding Analyses 12A.f.2. Anti-Human Capture Monomeric Tau-Binding Assay 12A.f.2.i. Chip Preparation Reagent preparation. EDC [1-ethyl-3(3-dimethylaminopropyl)carbodiimide] and NHS (N-hydroxysuccinimide) were dissolved by adding 10.0 ml of Milli-Q water to each vial. Vials were capped tightly and vortexed until the solids were completely dissolved. EDC, NHS, and ethanolamine solutions were aliquoted separately into 0.5 ml aliquots in 7 mm plastic vials, capped, and stored frozen at −20° C. Anti-human IgG (Fc) from kit was centrifuged in microfuge briefly to collect antibody at bottom of tube. 15 μL anti-human IgG (Fc) was removed to a new 1.5 mL microfuge tube and diluted to 300 μL with 285 μL immobilization buffer. Sample was vortexed briefly to mix, then 70 μL was aliquoted to 4 separate 7 mm tubes and capped. 4 aliquots each of EDC, NHS, and ethanolamine were thawed, vortexed briefly to mix and displace any air bubbles trapped on tube walls, and placed in Reagent Rack 2.

0.5 L of 1×HBS-P+(Assay Running Buffer) was prepared by diluting 50 mL 10×HBS-P+ to 0.5 L with 450 mL Milli-Q® water in 1 L Pyrex bottle.

Preparation of instrument for assay. A 1 L bottle of Assay Running Buffer was attached to Buffer A line on BIAcore® T-100, an empty 2 L Pyrex bottle to BIAcore® T-100 waste line, and a 1 L Pyrex bottle filled with fresh 1 L Milli-Q® water to water line. A new CM5 chip was docked into the instrument.

Capture antibody immobilization. In BIAcore® T-100 Control software, a new Wizard Template was opened and "Immobilization" was selected. Chip type was set to "CM5". Method was set to "Amine". Ligand blanks were filled in as "anti-human". Contact time was set to 360 sec for each flow cell and flow rate 5 µL/min. Following completion of these steps, assay was run.

12A.f.2.ii. Binding Assay

Binding experiments were performed using a BIAcore™ T-100 instrument or a T-200 instrument. Running buffer used for the binding assay was HBS-P+/0.2% BSA. 7G6-HCzu25LCzu18 samples were diluted to 100 µg/mL, 100 µL final in Assay Running Buffer, then centrifuged at 18,000×g for 10 min in microcentrifuge at ambient temperature. Dilution to 1 µg/mL was done by removing 40 µL supernatant and diluting to 4.0 mL with Assay Running Buffer in labeled 5 mL tubes. 1 µg/mL antibody solutions were transferred to labeled 1.5 mL capless plastic vials and capped with type 3 caps. Vials were vortexed briefly to remove any air bubbles adhered to tube walls or bottom and placed in Sample and Reagent Rack 1. 200 µL 1 µg/mL solution of diluted reference standard antibody was transferred to a 7 mm plastic vial, capped, vortexed briefly to dislodge adhered air bubbles, and placed in Sample and Reagent Rack 1 (for chip conditioning cycles). Recombinant human wild-type 2N4R tau protein was diluted to 1 µM, 0.5 mL final in Assay Running Buffer (1 mg/mL stock is 21.7 µM). Sample was centrifuged at 18,000×g for 10 min in microcentrifuge at ambient temperature and diluted to 100 nM by removing 400 µL supernatant and diluting to 4.0 mL with Assay Running Buffer in a labeled 5 mL tube. 100 nM solution was serially diluted 3-fold by removing 1333 µL 100 nM solution and diluting in 2667 µL Assay Running Buffer to a final volume of 4.0 mL (33.3 µL). Serial dilution was repeated 6 times, for a total of 8 dilutions (100 nM, 33.3 nM, 11.1 nM, 3.70 nM, 1.23 nM, 0.41 nM, 0.14 nM, and 0.046 nM tau). A 0 nM Tau protein solution was prepared by adding 3 mL Assay Running Buffer to labeled 5 mL tube. Analyte dilutions were transferred to labeled 4 mL plastic vials and capped with type 5 caps, vortexed briefly to remove any air bubbles adhered to tube walls or bottom, and placed in Sample and Reagent Rack 1. For chip conditioning analyte sample, 5 µL of 1 µM Tau protein solution supernatant was removed and diluted to 500 µL in Assay Buffer in a 7 mm plastic vial, capped, vortexed briefly to dislodge adhered air bubbles, and placed in Sample and Reagent Rack 1. Humanized antibodies were captured on flow cells 2, 3, and 4 sequentially at a flow rate of 10 µL/min for a contact time of 36 sec. Dilutions of Tau protein were injected over all 4 flow cells at a flow rate of 30 µL/min for a contact time of 300 sec. Dissociation was followed for 1800 sec. Following each cycle, the surface was regenerated by two sequential injections of 30 sec at 30 µL/min of 3 M $MgCl_2$ over all four flow cells. After the run, kinetic data fitting was performed using a 1:1 Langmuir model.

12B. Results

The affinity of recombinant human wild-type 2N4R Tau protein to 7G6-HCzu25LCzu18 antibody was determined using an antibody-capture format assay. Following capture of 7G6-HCzu25LCzu18 antibody, human Tau protein was injected over the ligand surface for 300 sec, followed by observation and measurement of dissociation for 1800 sec. After each antibody capture, Tau protein binding, and dissociation cycle, the chip surface was regenerated to the anti-human antibody capture surface using 3M $MgCl_2$, as required by the manufacturer. Tau protein was analyzed in a concentration range from 100 nM to 0.046 nM (3-fold diluted). The assay was performed in multi-cycle mode, such that a dissociation was performed for each tau protein injection. Each ligand was analyzed on all three flow cells (fc2, fc3, and fc4) in triplicate, in order to eliminate any flow cell-specific effects.

Capture levels of each ligand on each flow cell (relative to fc1) were determined. These results are listed in Table 13:

TABLE 13

| Capture levels of 7G6-HCzu25-LCzu18 ligands | | | |
|---|---|---|---|
| | fc2 | fc3 | fc4 |
| 7G6-HCzu25LCzu18, lot 17-0190 | 189.9 | 185.6 | 196.1 |
| 7G6-HCzu25LCzu18, lot 18-0146 | 177.0 | 173.7 | 183.1 |
| 7G6-HCzu25LCzu18, lot 17-0190ARS | 161.7 | 158.1 | 166.7 |

Data are expressed in RU.
Values represent averages of ligand capture levels for all relevant cycles.
fc—flow cell Captured ligand average levels were all between 158 RU and 196 RU. Only slight differences were observed between flow cells within a given ligand.

Binding data was double-referenced, meaning referenced to both fc1 with no ligand bound and to buffer analyte injections (0 nM Tau protein). Binding data was fitted to a 1:1 Langmuir binding model. This model is appropriate for the assay format, as bivalency of the antibody and resulting avidity effects are not relevant in an antibody capture format. Affinity data for each ligand on individual flow cells was averaged and standard deviation determined. These results are listed in Table 14:

TABLE 14

| Affinity constants for human Tau binding to 7G6-HCzu25LCzu18 | | | |
|---|---|---|---|
| | $k_a$ ($M^{-1}sec^{-1}$) | $k_d$ ($sec^{-1}$) | $K_D$ (M) |
| 7G6-HCzu25LCzu18, lot 17-0190 | $1.919 \pm 0.108 \times 10^6$ | $1.256 \pm 0.022 \times 10^{-4}$ | $6.565 \pm 0.493 \times 10^{-11}$ |
| 7G6-HCzu25LCzu18, lot 18-0146 | $1.916 \pm 0.093 \times 10^6$ | $1.259 \pm 0.027 \times 10^{-4}$ | $6.587 \pm 0.460 \times 10^{-11}$ |
| 7G6-HCzu25LCzu18, lot 17-1090ARS | $1.914 \pm 0.027 \times 10^6$ | $1.235 \pm 0.018 \times 10^{-4}$ | $6.451 \pm 0.163 \times 10^{-11}$ |

Data are expressed as average ⊥ standard deviation.
Averages are from kinetic data from each flow cell.

No significant differences in on rate, off-rate, or affinity were observed between the two 7G6-HCzu25LCzu18 drug substance lots and 7G6-HCzu25LCzu18 reference standard.

Example 13: Fine Epitope Mapping of 7G6-HCzu8-LCzu6 and 7G6-HCzu25-LCzu18

Fine epitope mapping was performed for 7G6-HCzu8-LCzu6 and 7G6-HCzu25-LCzu18 antibodies as described in Example 3.

The fluorescent images of the chips and resulting intensity plots show that the 7G6-HCzu8-LCzu6 (FIG. 26A) and 7G6-HCzu25/LCzu18 (FIG. 26B) antibodies both bind to two major sites on the full length Tau protein, similar to the murine 7G6 antibody (see FIG. 3). A stronger fluorescence intensity on the chip was observed generally for 7G6-HCzu25-LCzu18 resulting in some signs of signal saturation and therefore lack of true quantification for some but not all of the peptides. In this experiment, the data analysis software (PepSlide™ Analyser) identified the minimum binding sequence for 7G6-HCzu8-LCzu6 as KHVPGGG (SEQ ID NO: 1135) for the site within the second repeat (positions 298 to 304) and HVPGG (SEQ ID NO: 79) for the site within the fourth repeat (positions 362 to 366) of 2N4R protein. For 7G6-HCzu25-LCzu18, the software identified the minimum required sequence as HVPG (SEQ ID NO: 1133) for both binding sites.

Similar to murine 7G6, minor binding was observed at two additional sites: HQPGG (SEQ ID NO: 183) at amino acid positions 268 to 272 and HKPGG (SEQ ID NO: 182) at positions 330 to 334 for both 7G6-HCzu8-LCzu6 and 7G6-HCzu25-LCzu18 antibodies. Calculation of average signal intensities for peptides containing the HXPGG sequence (SEQ ID NO: 1136) demonstrated that the 7G6-HCzu8-LCzu6 human antibody showed a 108-fold or 104-fold preference in binding to the HVPGG site (SEQ ID NO: 79) normally contained within the second repeat region of full length 2N4R Tau compared to the HQPGG (SEQ ID NO: 183) (repeat region 1) or HKPGG (SEQ ID NO: 182) (repeat region 3) sequences, respectively. Similarly, a 99-fold or 95-fold preference in 7G6-HCzu8-LCzu6 binding to the HVPGG (SEQ ID NO: 79) site normally contained within the fourth repeat region of full length 2N4R Tau compared to the HQPGG (SEQ ID NO: 183) (repeat region 1) or HKPGG (SEQ ID NO: 182) (repeat region 3) sequences, respectively, was observed. Identical data analysis for 7G6-HCzu25-LCzu18 demonstrated a 65-fold or 100-fold preference in binding to the HVPGG (SEQ ID NO: 79) site normally contained within the second repeat region of full length 4R Tau compared to the HQPGG (SEQ ID NO: 183) (repeat region 1) or HKPGG (SEQ ID NO: 182) (repeat region 3) sequences, respectively. Likewise, a 77-fold or 119-fold preference in 7G6-HCzu25-LCzu18 binding to the HVPGG (SEQ ID NO: 79) site normally contained within the fourth repeat region of full length 4R Tau compared to the HQPGG (SEQ ID NO: 183) (repeat region 1) or HKPGG (SEQ ID NO: 182) (repeat region 3) sequences, respectively, was observed.

Example 14: Epitope Substitution Scanning of 7G6-HCzu8-LCzu6 and 7G6-HCzu25-LCzu18

Epitope substitution scanning was performed for 7G6-HCzu8-LCzu6 and 7G6-HCzu25-LCzu18 antibodies as described in Example 4.

The substitution scanning showed that of the $^1$HVPGG$^5$ (SEQ ID NO: 79) sequence, both 7G6-HCzu8-LCzu6 and 7G6-HCzu25-LCzu18 antibodies require the $^1$H, $^3$P and $^4$G residues with some substitution tolerability at $^2$V for peptide binding. These findings were similar to those observed for the murine 7G6 antibody (see Example 4). Some tolerability for substitution was also observed at the second glycine residue ($^5$G) of the $^1$HVPGG$^5$ (SEQ ID NO: 79) sequence in this case. However, this residue was still able to exert considerable influence over the binding of 7G6-HCzu25-LCzu18 and 7G6-HCzu8-LCzu6 antibodies to the longer wild type peptide sequence. Together with Example 13, these results indicate that the HVPGG (SEQ ID NO: 79) sequence facilitates efficient binding of 7G6, 7G6-HCzu25-LCzu18 and 7G6-HCzu8-LCzu6 antibodies to 2N4R Tau at positions 299 to 303 and 362 to 366 within the second and fourth repeats, respectively.

Example 15: In Vitro Tau Aggregation with 7G6-HCzu25-LCzu18

Experiment 1

To determine whether 7G6-HCzu25-LCzu18 antibody could inhibit Tau aggregation in vitro, the antibody was tested in the assay described in Example 5 using the wild type Tau protein with minor modifications. The only difference was the control IgG used in this case was a human IgG1 antibody (BioXCell, catalogue number BE0297).

Figure 27:
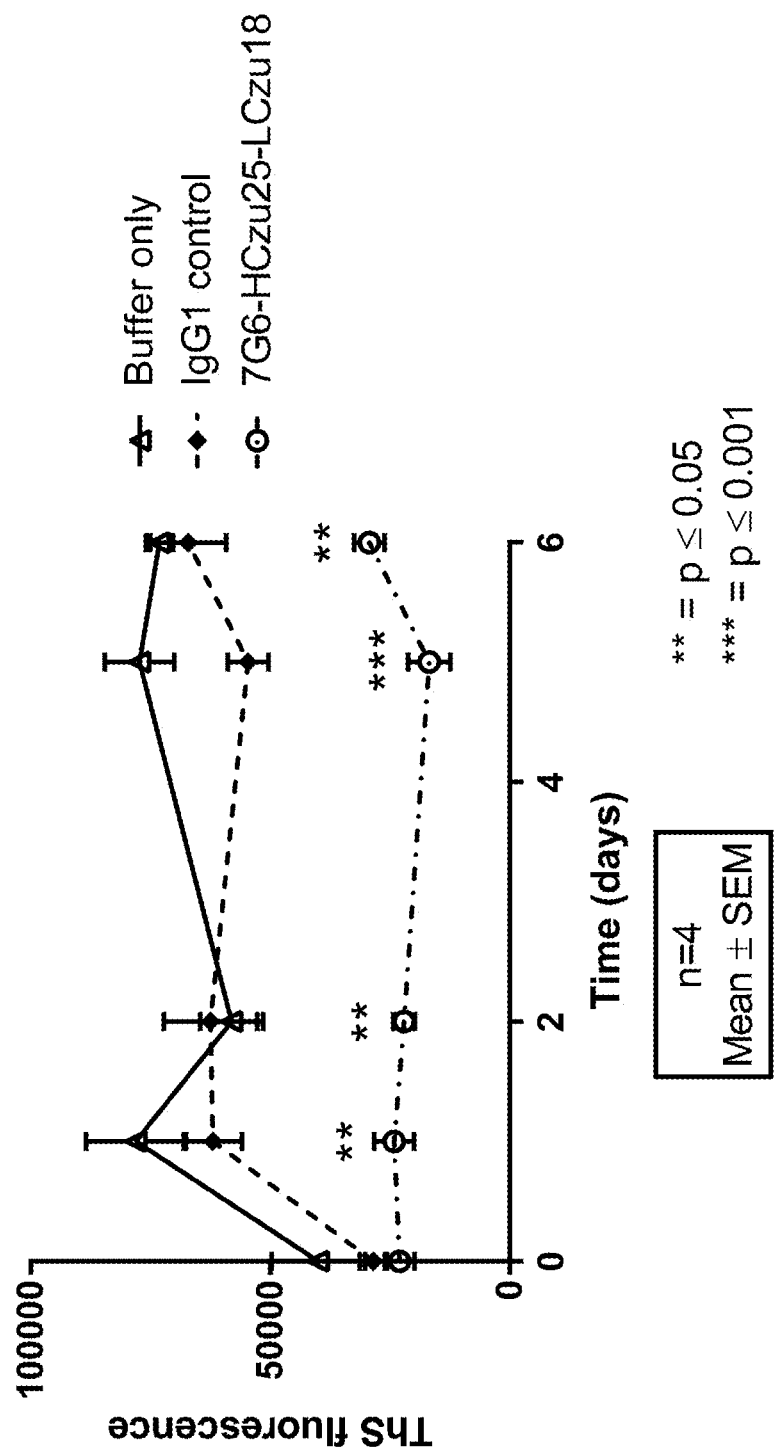
FIG. 27 illustrates the degree and rate of heparin-induced aggregation for the wild-type 2N4R Tau protein in the presence and absence of antibody 7G6-HCzu25-LCzu18. Recombinant wild-type 2N4R Tau was induced to aggregate under the conditions described in Example 15. Reactions contained either no antibody (buffer only; open triangle), a human IgG1 control antibody (solid diamond), or antibody 7G6-HCzu25-LCzu18 (open circle). Thioflavin S (ThS) fluorescence was measured immediately after heparin addition (day 0) and then on days 1, 2, 5 and 6 thereafter. Data is represented as mean±SD from four independent experiments. Statistical analysis (multiple t-tests comparing IgG control and antibody 7G6-HCzu25-LCzu18) was performed for each time point (p≤0.01 ; p≤0.001 *).

In this assay, 7G6-HCzu25-LCzu18 antibody was tested over a time course of several days. FIG. 27 shows that 7G6-HCzu25-LCzu18 could effectively inhibit Tau aggregation in vitro. The effect was statistically significant (t-test) when comparing the IgG control and 7G6-HCzu25-LCzu18 for days 1, 2, 5 and 6 following incubation at 37° C. No significance was observed on day 0 just after the reactions were initiated following heparin addition.

Experiment 2.

To confirm the humanized 7G6-HCzu25-LCzu18 antibody was comparable to the murine 7G6 antibody at inhibiting Tau aggregation in vitro, both antibodies were compared in the same in vitro Tau aggregation assay. The conditions used were identical to those in Experiment 1 of this Example with the exception that the same mouse IgG2b control antibody was used that was described in Example 5.

Figure 28:
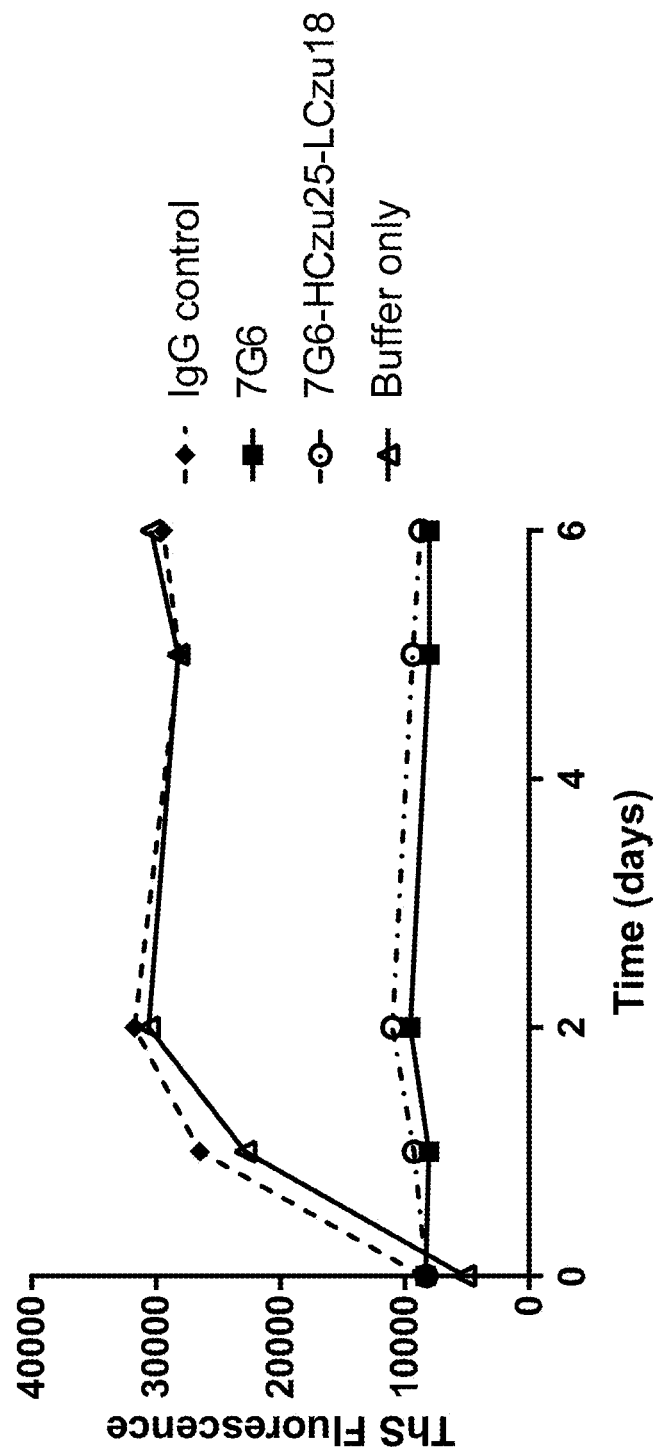
FIG. 28 illustrates the degree and rate of heparin-induced aggregation for the wild-type 2N4R Tau protein in the presence and absence of antibody 7G6 or antibody 7G6-HCzu25-LCzu18. Recombinant wild-type 2N4R Tau was induced to aggregate under the conditions described in the materials and methods. Reactions contained either no antibody (buffer only; open triangle); a human IgG1 control antibody (solid diamond); antibody 7G6 (solid square); or antibody 7G6-HCzu25-LCzu18 (open circle). Thioflavin S (ThS) fluorescence was measured immediately after heparin addition (day 0) and then on days 1, 2, 5 and 6 thereafter.

When both murine antibody 7G6 and humanized antibody 7G6-HCzu25-LCzu18 were tested according to the assay conditions provided in Example 5, both antibodies effectively inhibited Tau aggregation in vitro. As shown in FIG. 28, the same effect size was seen between murine 7G6 and 7G6-HCzu25-LCzu18 antibodies.

Example 16: Cell-Based Seeding Assay Using K18 Tau Fibril Following Immunodepletion with 7G6-HCzu25-LCzu18

To determine whether immunodepletion of Tau seeds from cell culture medium could prevent further Tau aggregation within cells, the same HEK293 assay system as described in Example 6 was used. In this case however, a potent truncated form of Tau (K18) fibrils were used as Tau seeds rather than full length protein as described previously. The K18 fragment has been studied extensively and is normally expressed recombinantly as residues 244 to 372 of the full length 2N4R Tau protein. This fragment encodes the microtubule binding region of Tau and has been reported to be more aggregate-prone than the full length protein (Shammas et al., Nature Comms., 6, Article number: 7025 (2015))

as well as having the ability to form potent seeds in cell-based assays (Kfoury et al., 2012, J. Biol. Chem., 287: 19440-19451).

Materials and Methods:

Preparation of K18 Fibrils.

Recombinant human Tau-441 (244-372; "K18") (Signal-Chem) was dissolved in ultrapure water. Fibrils were generated by mixing together final concentrations of 40 μmol/L K18 protein, 100 mmol/L sodium acetate (pH 7), 2 mmol/L DTT and 240 μg/mL heparin. Reactions were agitated for three days at 37° C. Following incubation, the solution was centrifuged at 135,000 g for 20 minutes at room temperature. The supernatant was discarded, and the pellet was resuspended in 100 mmol/L sodium acetate (pH 7). Aggregated protein was sonicated briefly and then diluted with D-PBS (−) to a concentration of 50 μg/mL and stored at −80° C.

Preparation of Immunodepleted and Immunoprecipitated Samples.

Immunoprecipitation of the prepared K18 fibrils was performed using the Immunoprecipitation Dynabeads® Protein G kit (Thermofisher Scientific, catalogue number 10007D) as per the manufacturer's instructions. Briefly, each immunoprecipitation used 1.5 mg of Dynabeads bound to either 3 or 0.3 μg of 7G6-HCzu25-LCzu18 antibody. Vehicle (no antibody) or 3 μg of commercially available human IgG1 antibody (Bio-Rad Laboratories, Inc.; catalog number HCA192) were included as controls. Antibody-bound (or vehicle-treated) beads were resuspended in 170 μL of buffer containing 0.2% BSA. The K18 fibril solution was then thawed, diluted to 10 μg/mL in PBS, and added to the antibody-bound beads to give a final volume of 200 μL (containing 300 ng of K18 total). This gave final concentrations of either 15 or 1.5 μg/mL of antibody in each immunoprecipitation reaction. Beads were incubated with the K18 fibrils for 20 minutes at room temperature with rotation and non-bound material was retained as the immunodepleted (ID) sample. Antibody-bound material was eluted in 20 μL of the buffer provided in the kit and also retained to provide the immunoprecipitated (IP) samples.

Cell-Based Assay.

Polyethylenimine (PEI) solution was diluted in purified water to a final concentration of 0.1% and then used to coat a 96-well tissue culture plate at 37° C. for at least one night. Plates were then washed twice with water before adding 150 μl of Dulbecco's modified Eagle's Medium (D-MEM) containing 10% fetal bovine serum and 1% penicillin/Streptomycin ("DMEM (+FBS, P/S)") medium to each well prior to conducting the assay.

Lenti-X 293T (Takar Bio Inc.) cells routinely maintained in D-MEM (+FBS, P/S) at 37° C. with 5% $CO_2$ were transfected in suspension in the same media without antibiotics prior to Tau seed addition. For transfection, 7 μg of pcDNA3.1(+) (Invitrogen) mammalian expression vector containing cDNA encoding the mutant P301S 0N4R Tau isoform was mixed with LTX and Plus™ Reagent (Life Technologies, catalog number 15228-100) as per the manufacturer's recommendation. The resulting mixture was incubated for at least 25 minutes at room temperature before adding directly to a suspension of $6.0\times10^6$ Lenti-X 293T cells at a density of $1.0\times10^5$ cells/mL. Media was removed from the precoated plate and the treated cell suspension was dispensed at 150 μL per well ($1.5\times10^4$ cells/well) and incubated for 19 hours at 37° C. in a 5% $CO_2$ atmosphere.

Once thawed on ice, 30 μL of each ID sample was diluted into 420 μL of Opti-MEM® I Reduced-Serum Medium (ThermoFisher Scientific, catalogue number 31985-062). For IP samples, solutions were also thawed on ice and 2 μL of each was diluted into 50 μL of Opti-MEM® I Reduced-Serum Medium. Then 2.5 μL of P3000 (Thermofisher Scientific, catalog number L3000-008) was added. In a separate tube, 22 μL of Lipofectamine® 3000 (Thermofisher Scientific, catalog number L3000-008) was diluted into 550 μL Opti-MEM® I Reduced-Serum Medium. Then, 52 μL of the diluted Lipofectamine 3000 solution was added to each IP sample containing the P3000 reagent.

Plated cells were washed twice and left in 75 μL of Opti-MEM® I Reduced-Serum Medium (ThermoFisher Scientific). An equal volume of diluted ID or IP sample as described above was added to each well and incubated for 44 hours at 37° C. in a 5% $CO_2$ atmosphere. The experiment was performed in quadruplicate.

Immunocytochemistry.

After two days of incubation, cells were fixed in 4% paraformaldehyde for 30 minutes at room temperature. Each well was washed 3 times with 100 μL of purified water and then left in 70 μL of Permeabilization/Blocking/DAPI staining buffer (Triton X-100 solution (final concentration: 0.2%) and Cellstain® DAPI solution (final concentration: 0.1%; Dojindo) diluted in 5% BSA in TBS) was added to each well. The plate was covered and incubated for 30 minutes at room temperature with protection from light. After incubation, Permeabilization/Blocking/DAPI staining buffer was removed, and 80 μL Thioflavin S (ThS) staining buffer (Thioflavin S dissolved in 50% Ethanol to a final concentration of 0.0003%) was added to each well and incubated for 40 minutes at room temperature. Then, each well was washed twice with 50% ethanol and replaced with 250 μL of purified water.

Imaging Assay.

Fluorescence images of each well were obtained by an InCell® Analyzer 2200 (GE Healthcare) (ThS: Excitation [Ex]/Emission [Em]=475/511 nm, DAPI: Ex/Em=390/435 nm). Numbers of ThS and DAPI positive signal in each well were then analyzed using the InCell Developer Software (GE Healthcare).

Data Analysis.

The ThS positive rate was calculated using the following formula:

ThS positive rate=ThS/DAPI

=number of ThS positive signals/number of DAPI positive signals.

Then, the seeding effect of ID or IP samples were calculated using the following formulas (Software: TIBCO Spotfire):

The seeding effect of ID sample (% of control)=$T_1/C_1 \times 100$, where $T_1$: Average of ThS positive rate in the antibody treated ID sample, and $C_1$: Average of ThS positive rate in the buffer treated ID sample.

The seeding effect of IP sample (% of control)=$T_2/C_2\times 100$, where $T_2$: Average of ThS positive rate in the antibody treated IP sample, and $C_2$: Average of ThS positive rate in the 7G6-HCzu25-LCzu18 antibody (15 μg/mL)-treated IP sample.

Figure 29:
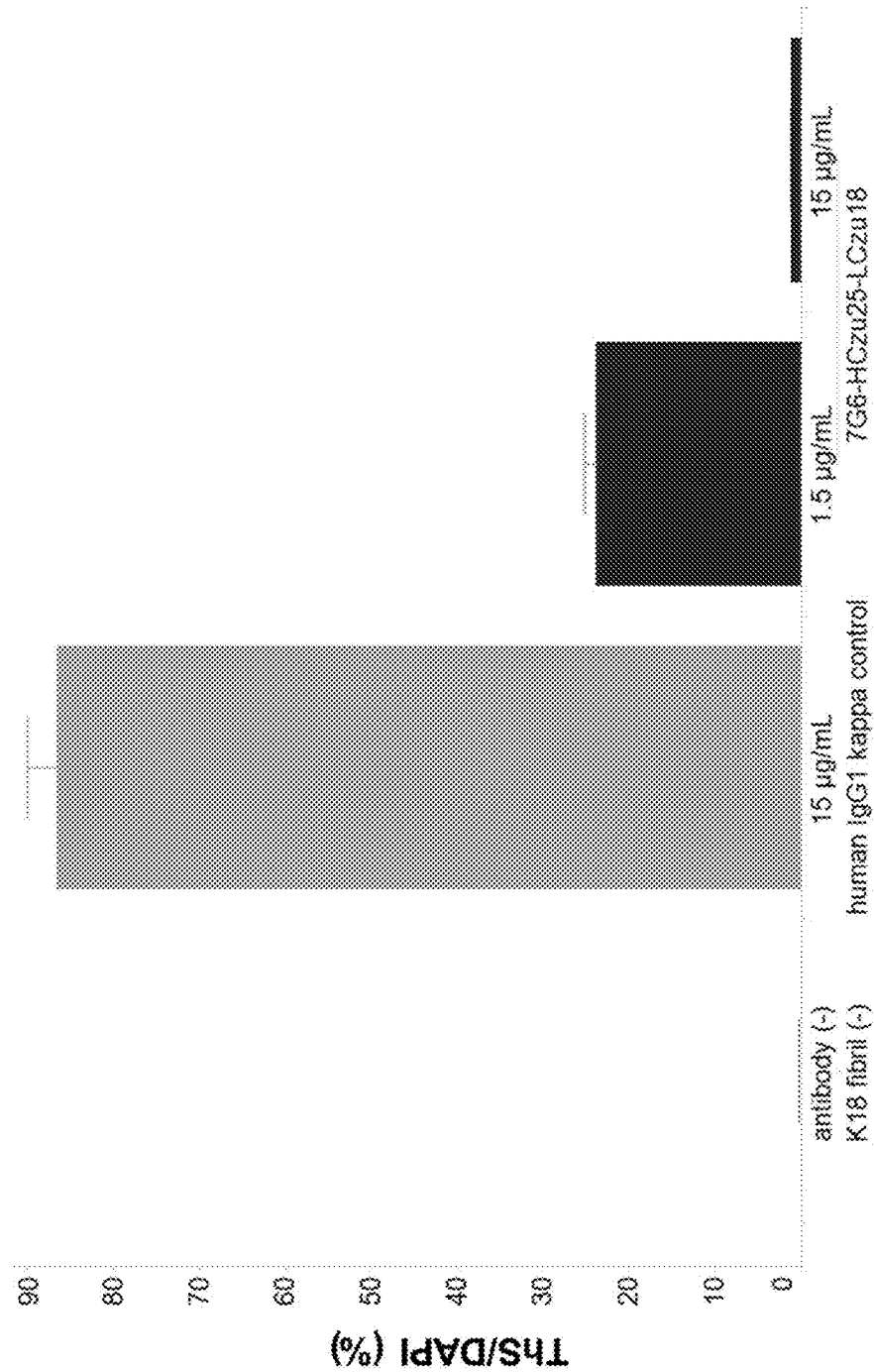
FIG. 29 shows the normalized ThS positive rate in a K18 fibril cell-based seeding assay after immunodepletion of samples with 7G6-HCzu25-LCzu18 antibody. 1.5 and 15 µg/ml of 7G6-HCzu25-LCzu18 antibody removed seeding effects of K18 fibril (>70% reduction vs human IgG1 kappa control).

FIG. 29 shows the normalized ThS positive rate in the cell-based seeding assay after treatment of ID samples. 1.5 and 15 μg/ml of 7G6-HCzu25-LCzu18 antibody removed the seeding effects of K18 fibril (>70% reduction vs human IgG1 kappa control). For the IP samples, 7G6-HCzu25-LCzu18 antibody efficiently induced seeding effects in a concentration-dependent manner (data not shown).

Example 17: Intrahippocampal P301S Tau Seed Injection Model with 7G6

Materials and Methods:

Tau seed was generated by mixing recombinant human 2N4R P301S Tau (40 µmol/L) and heparin (240 µg/mL), followed by an incubation step at 37° C. for 48 to 96 hours in 100 mmol/L sodium acetate, pH7.0, containing 2 mmol/L Dithiothreitol (DTT). Aggregated Tau was collected by ultracentrifugation and resuspended in 100 mmol/L sodium acetate, pH7.0. The resulting fibrils were sonicated and used as seeds for injection.

3 µL of Tau seed (1.5 mg/mL) or non-seed (100 mmol/L sodium acetate, pH7.0) was stereotaxically injected into left hippocampus (A: +2.5, L: 2.0, V: 1.5) (Franklin and Paxinos, The Mouse Brain in Stereotaxic Coordinates Third Edition 2007, Elsevier USA) of 3- to 4-month-old Mouse/Thy-1hTau.P301S (CBA.C57BL/6) mice [homozygous human P301S Tau transgenic mouse (C57BL/6) generated previously (Allen et al., J Neurosci. 2002; 22:9340-51)] using an UltraMicroPump III and Micro4 Controller (World Precision Instruments) at 0.5 µL/min for 6 minutes. Mice were randomly divided into groups as shown in Table 15. Anti-human Tau mouse IgG2b monoclonal antibody, clone 7G6 or mouse IgG2b isotype control antibody (clone MPC11, BioXCell) in formulation buffer (25 mmol/L Sodium phosphate, 0.15 mol/L NaCl, pH6.5)) were administered intro-peritoneally to reach a dose of 40 mg/kg in the groups that had received seed. The same formulation buffer was administered to the non-seed group. Dosing was performed 6-16 hours before, and 1 and 2 weeks after Tau seed injection (total 3 times). The administration volume (10 mL/kg) was calculated from the body weight before administration.

TABLE 15

Treatment Groups

| Study | Group No. | Treatment | Number of animals[‡] |
|---|---|---|---|
| Pharmacological study | 1 | Non-seed + Vehicle | 6 |
| | 2 | Tau seed + Control IgG | 11 |
| | 3 | Tau seed + 7G6 | 11 |

"Non-seed" represents injection of solution (100 mmol/L sodium acetate, pH 7.0) into left hippocampus, and "Tau seed" represents injection of 1.5 mg/mL Tau seed solution into left hippocampus. Control IgG = Mouse IgG2b isotype control antibody, 7G6—Anti-human tau mouse IgG2b monoclonal antibody.
[‡]Tissue from an additional five animals in the non-seed group and 11 animals for both treatment groups that received seed was processed by adding buffer containing sarkosyl to the tissue directly instead of RIPA buffer. These additional animals were therefore not included in the data analysis. A reduction in insoluble Tau (after extracting with buffer containing sarkosyl twice) was still observed, however, in these additional animals.

All mice were deeply anesthetized with a combination anesthetic (M/M/B: 0.3/4/5; prepared with 0.9 mg/kg of medetomidine, 12.0 mg/kg of midazolam, and 15 mg/kg of butorphanol), and plasma and cerebrospinal fluid (CSF) were collected. Then, the cortex and hippocampus from both sides (ipsilateral and contralateral) were separately dissected following intracardiac perfusion with saline. Brain tissues were immediately frozen in liquid nitrogen and stored at −80° C.

Dissected brain tissues were homogenized in 19 volumes (tissue weight/volume) of extraction buffer ("RIPA buffer") containing 50 mmol/L Tris-HCl (pH7.5) (Invitrogen), 5 mmol/L EDTA (Nippon Gene), 1 mmol/L EGTA (Nacalai Tesque), 1% NP-40 Alternative (EMD Millipore), 0.25% Sodium Deoxycholate (Bio world), 0.1 mol/L NaCl, 0.5 mmol/L PMSF (Sigma Aldrich), 1× PhosSTOP™ (Roche), and 1× Complete EDTA(−) (Roche). Homogenates were centrifuged at 163,000 g at 4° C. for 20 minutes and the pellet was resuspended in 10 volumes (tissue weight/volume) of buffer containing 10 mmol/L Tris-HCl (pH7.5), 0.5 mol/L NaCl, 1 mmol/L EGTA, 10% sucrose (Wako Pure Chemical), and 1% sarkosyl prior to sonication. Sarkosyl-treated samples were incubated at 37° C. for 60 minutes, and then centrifuged at 163,000 g at 4° C. for a further 20 minutes. Finally, 10 volumes of PBS (Gibco) was added to the pellet which was subsequently sonicated. This formed the sarkosyl-insoluble fraction.

The amount of Tau protein in the sarkosyl-insoluble fraction was quantified by Western blot analysis. Sarkosyl-insoluble fractions were solubilized in NuPAGE™ LDS sample buffer (Novex) and NuPAGE™ sample reducing agent (Invitrogen), heated at 80° C. for 10 minutes, and separated using 12.5% polyacrylamide gels (DRC). Proteins were transferred to 0.2 µm PVDF membranes (Bio-Rad) and blots were blocked in 2.5% skimmed milk (Yukijirushi) in TBS (Takara) containing 0.05% Tween (Nacalai tesque) for 1 hour at room temperature. After blocking, blots were probed with the human-specific monoclonal anti-Tau antibody HT7 (1:1000, Thermo Fisher Scientific) in blocking buffer for 1 hour at room temperature. The blots were washed in TBS-T for 30 minutes and then incubated with HRP-conjugated anti-mouse IgG (1:2000, GE healthcare) for a further 1 hour at room temperature. Secondary antibody was removed and blots were washed as described above. Tau proteins were detected by chemiluminescent horseradish peroxidase (HRP) substrate (Merck Millipore) and quantified using the Fusion FX and FusionCapt version 16.15 (Vilber-Lourmat, France). To determine the amount of Tau, serial dilutions of Tau standards derived from the originating sarkosyl-insoluble fraction of P301S spinal cord (1, 2, 5, 10, 20 Arbitrary Unit [AU], 1 AU is equivalent to the band density of human Tau protein detected by HT7 antibody in sarkosyl insoluble fraction from 7 µg of spinal cord) were loaded onto each gel. The data calculated as less than 1 AU (detection limit) was expressed as 0.5 AU.

Data are expressed as the mean±SEM. The differences in sarkosyl-insoluble Tau between the Non-seed, control IgG-treated and 7G6-treated groups were analyzed by 1-way analysis of variance (ANOVA) followed by Fisher's LSD test. A value of $P<0.05$ (two sided) was considered statistically significant. Statistical analyses were performed using the GraphPad Prism version 7.02 (GraphPad Software).

Results

Figure 30A:
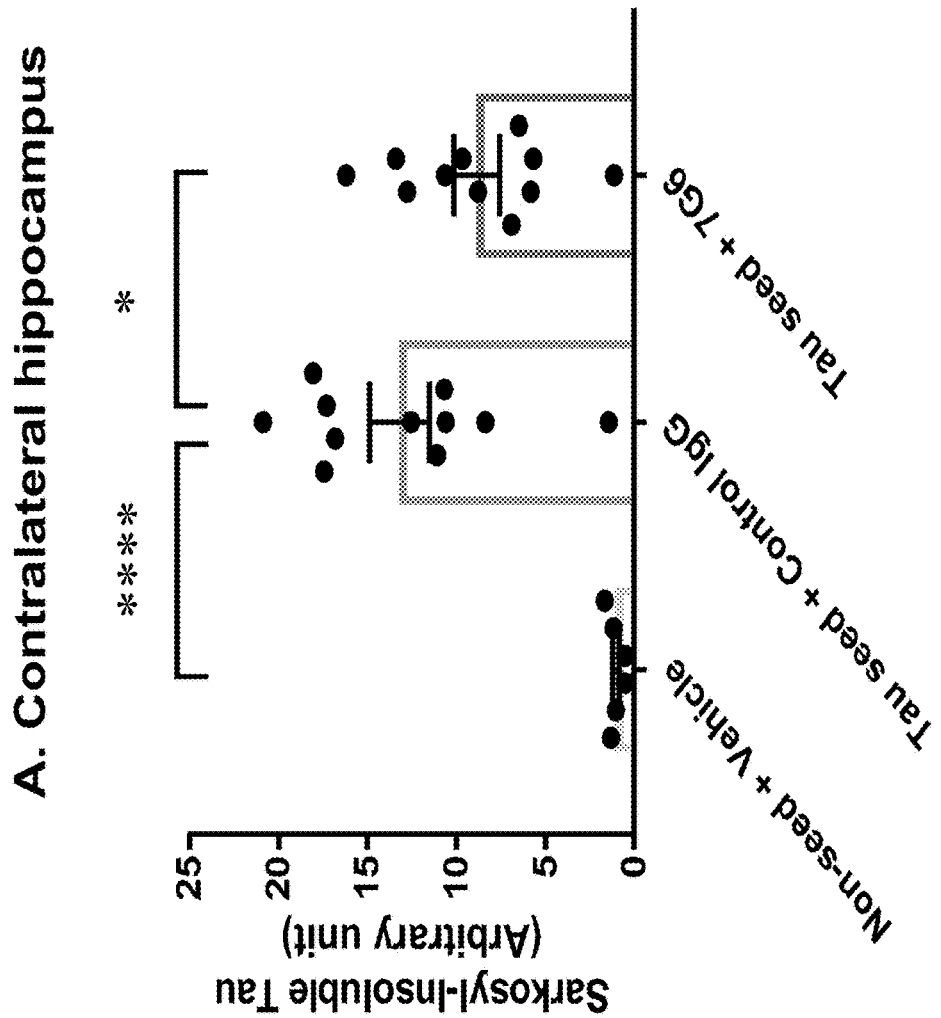
FIGS. 30A-30D illustrate the effect of antibody 7G6 on brain sarkosyl-insoluble Tau induced by intra-hippocampal Tau seed injection in human P301S Tau transgenic mice. Tau seed or non-seed (100 mmol/L sodium acetate, pH7.0) was stereotaxically injected into the left hippocampus. 7G6 or control IgG at 40 mg/kg was intraperitoneally administered once weekly for 3 weeks. Control IgG=Mouse IgG2b isotype control antibody, 7G6=Anti-human Tau mouse IgG2b monoclonal antibody Data represent the mean±SEM (n=6 for Non-Seed, n=11 for Control IgG, 7G6). **** $P<0.0001$, * $P<0.05$ versus control IgG (analyzed by 1-way ANOVA followed by Fisher's LSD test). The intraperitoneal administration of 7G6 once weekly for 3 weeks at 40 mg/kg produced significant suppression of the increase of sarkosyl-insoluble Tau in the contralateral hippocampus induced by intra-hippocampal Tau seed injection in P301S Tau transgenic mice.
Figure 30B:
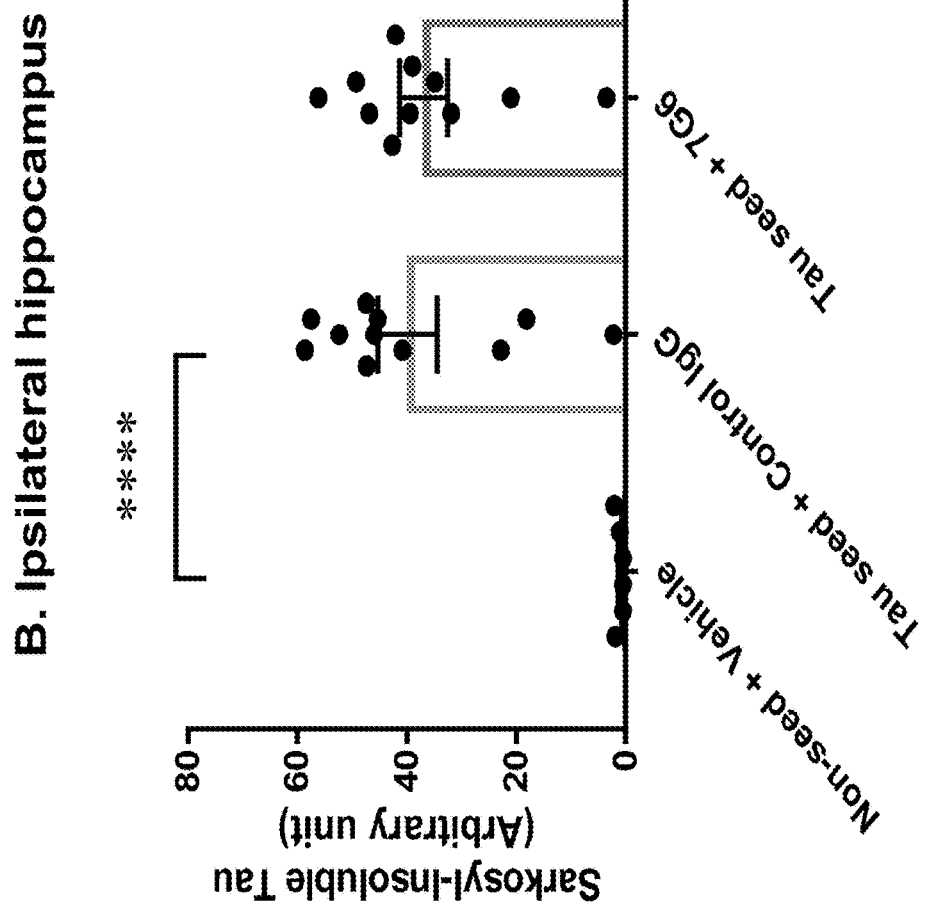
Figure 30C:
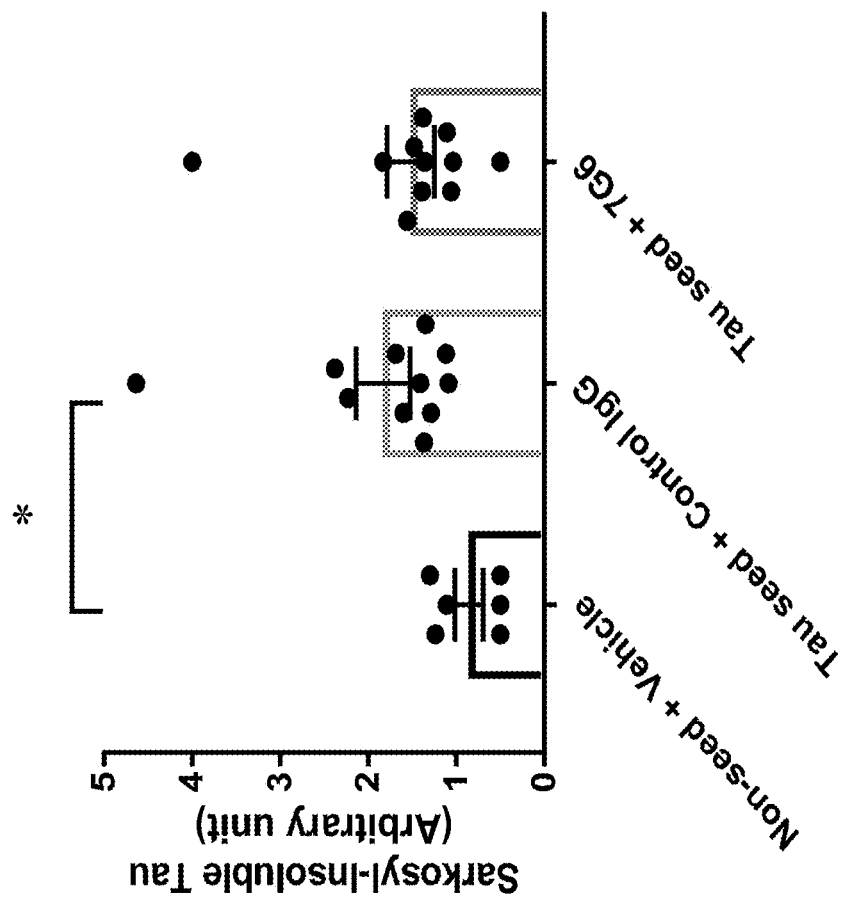
Figure 30D:
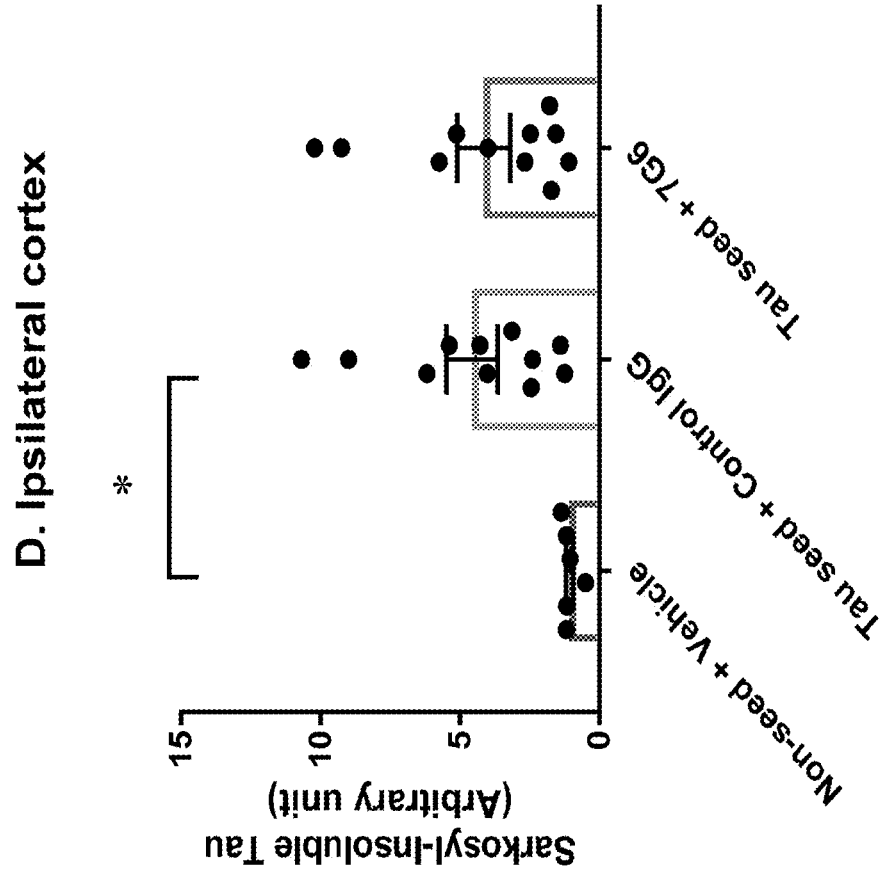

The effect of 7G6 on sarkosyl-insoluble Tau induced by intra-hippocampal Tau seed injection was examined in both ipsilateral (injection side) and contralateral cortex and hippocampus, separately. As shown in FIGS. 30A-30D, 7G6 significantly suppressed the increase of sarcosyl-insoluble Tau in the contralateral hippocampus compared with control IgG (FIG. 30A), but showed no significant effects in other regions (FIGS. 30B, 30C, and 30D). This suggests that 7G6 was able to prevent Tau transmission in this in vivo model.

Example 18: 7G6-HCzu25-LCzu18 Translational Biomarker Data

Male cynomolgus monkeys were treated with vehicle or 7G6-HCzu25-LCzu18 antibody (10, 30, and 100 mg/kg: 3 animals/dose) by intermittent intravenous administration once weekly for 4 weeks. MTBR-Tau (any isoform of full length or truncated Tau containing the MTBR) bound to 7G6-HCzu25-LCzu18 antibody ("Bound MTBR-Tau") and unbound form ("Free MTBR-Tau") in the cerebrospinal fluid ("CSF") collected from each monkey were separated by a Protein A column and analyzed by liquid chromatography coupled with mass spectrometry (LC/MS). LC/MS analysis was performed using UltiMate™ 3000 Nano LC system coupled to Orbitrap Fusion™ Lumos™ Tribrid™ mass spectrometer (Thermo Fisher Scientific, San Jose, Calif.) with needle column (3 μm C18 particle, 150 mm length, 100 μm inner diameter). A spray voltage of 2000 V was applied through a metallic tee connector. The flow rate was 500 nL/min. The mobile phases consisted of (A) 0.5% acetic acid in 4% acetonitrile and (B) 0.5% acetic acid in 80% acetonitrile and a multi-step linear gradient of 1% to 1% B for 5 min, 1% to 37% B for 15 min, 37% to 68% B for 5 min, 68% to 99% B for 1 min and 99% to 99% B for 4 min was employed to elute the analyte and then equilibrated by the initial condition, 1% B. A specific peptide containing 7G6-HCzu25-LCzu18 antibody epitope was measured by LC/MS as a proxy of MTBR-Tau. The amount of MTBR-Tau was expressed as the chromatographic peak area ratio of the specified peptide (Light) and its internal standard (Heavy), isotope-labelled peptide.

Figure 31A:
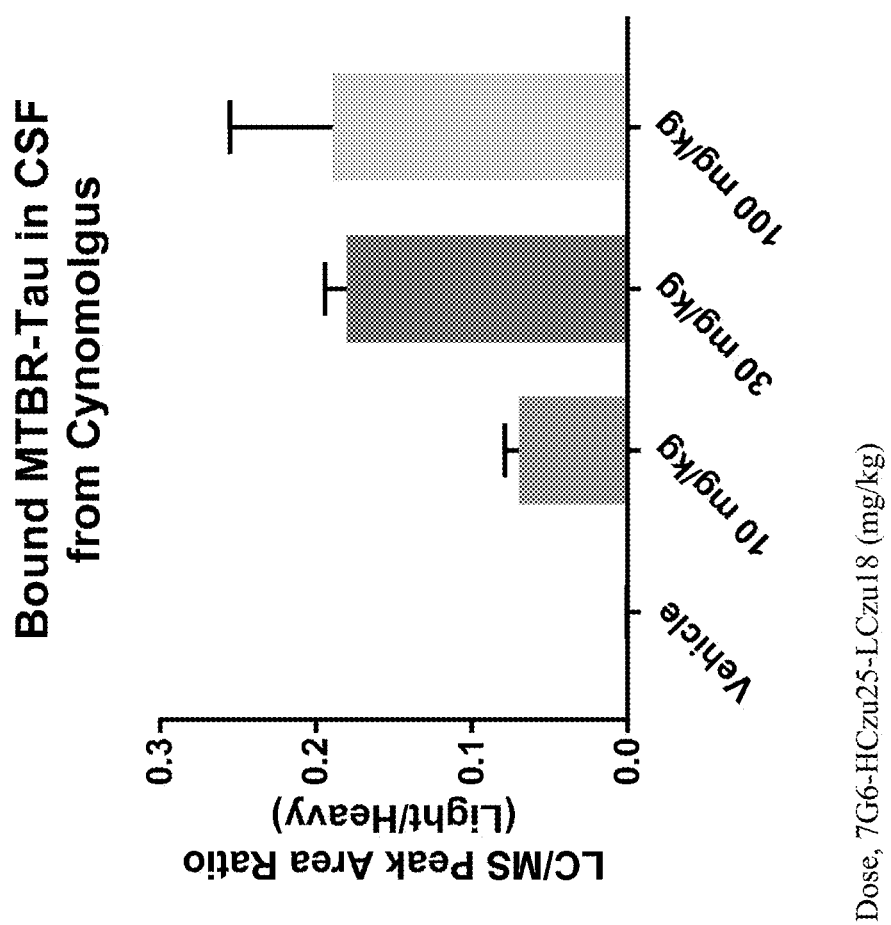
FIGS. 31A and 31B show MTBR-Tau in cerebrospinal fluid from cynomolgus monkey treated with 7G6-HCzu25-LCzu18 antibody.
Figure 31B:
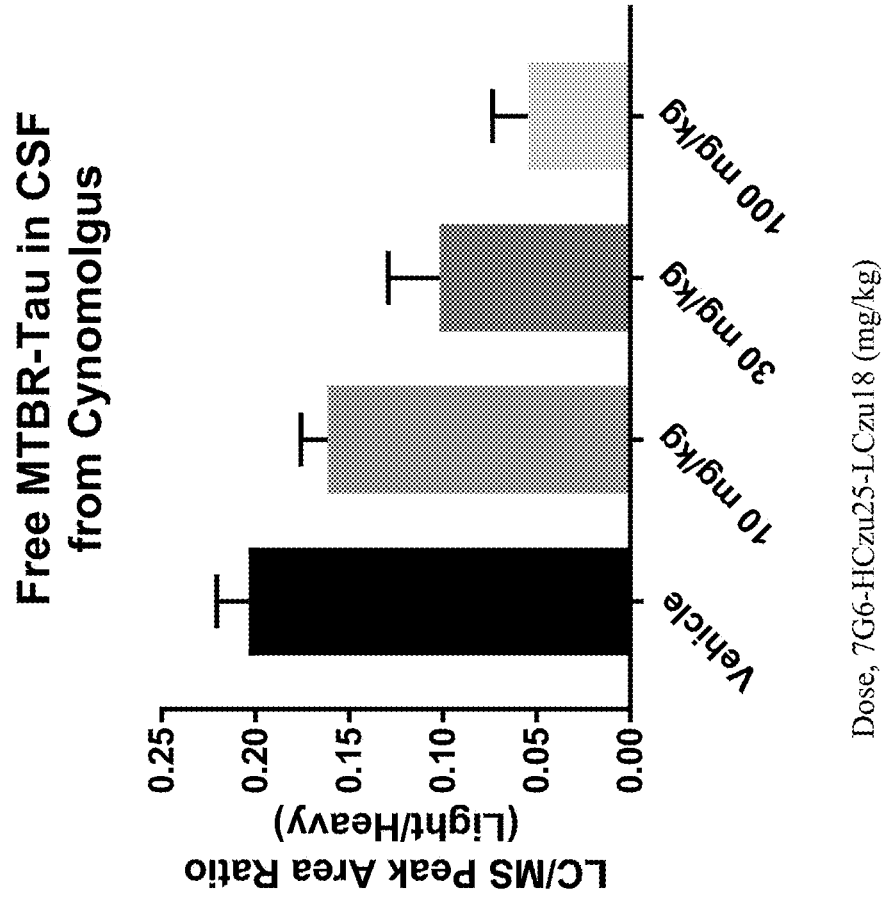

As shown in FIG. 31A, the amount of bound MTBR-Tau in CSF increased with treatment of the 7G6-HCzu25-LCzu18 antibody in a dose-dependent manner, whereas the amount of free MTBR-Tau in monkey CSF decreased also with dose-dependency (FIG. 31B). This suggests in vivo target engagement of the 7G6-HCzu25-LCzu18 antibody in monkey CSF.

Figure 32:
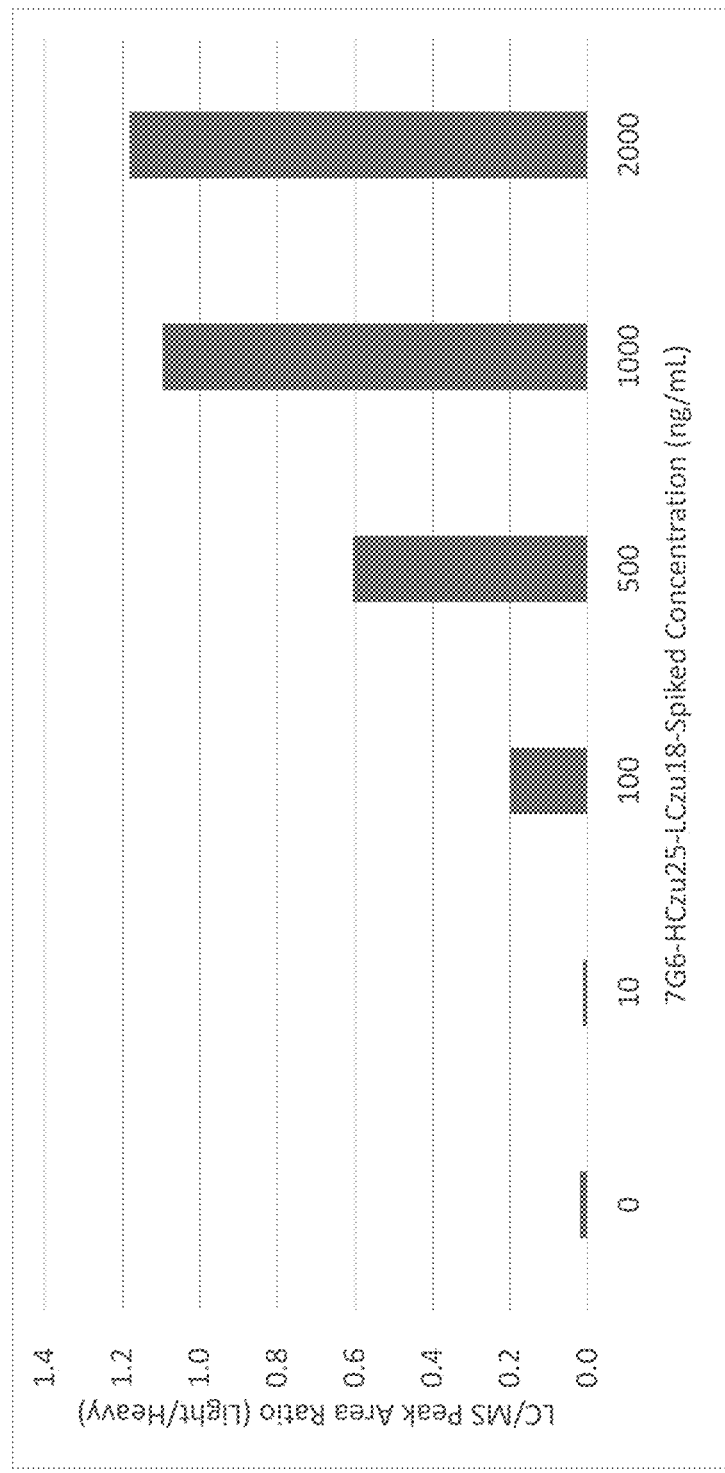
FIG. 32 shows bound MTBR-Tau in human cerebrospinal fluid spiked with 7G6-HCzu25-LCzu18 antibody (10, 100, 500, 1000 and 2000 ng/mL).

7G6-HCzu25-LCzu18 antibody was also spiked into human CSF at 10, 100, 500, 1000 or 2000 ng/mL. Then, MTBR-Tau bound by 7G6-HCzu25-LCzu18 was assayed by liquid chromatography coupled with mass spectrometry (LC/MS) in the same way as described above. As shown in FIG. 32, the amount of the bound MTBR-Tau in human CSF increased by treatment of 7G6-HCzu25-LCzu18 antibody with dose-dependency. This data also indicates target engagement of 7G6-HCzu25-LCzu18 antibody for MTBR-Tau in human CSF.

Example 19: Measurement of Tau Uptake in CD32A Overexpressing CHO Cells

Preparation of Labelled Tau Monomers and Fibrils.

Wild type recombinant full length human 2N4R Tau aggregates were prepared from monomers as described for the P301S protein in Example 17. Prior to labelling, aggregates were sonicated to generate the fibrils used in the assay. Both Tau fibrils and monomers were fluorescently labelled using the DyLight™ 488 NHS-Ester kit (ThermoFisherScientific, Cat#46403) according to the manufacturer's instructions with minor differences between the two forms of protein: 150 μL of Tau monomer (100 μM) was mixed with 100 μL of DyLight NHS Ester solution whereas 300 μL of Tau-441 fibril (587 μg/mL) was mixed with 66 μL of DyLight NHS Ester solution. Labelling was performed at room temperature for one hour. Excess unconjugated dye was removed with Pierce™ Dye Removal Columns (ThermoFisherScientific, Cat#22858, lot# SL260099) according to the manufacturer's protocol using 125 μL of labelled Tau monomer or 122 μL of labelled fibrils. Final concentrations of labelled Tau monomers and fibrils were measured by bicinchoninic acid assay (BCA) assay, and stored at −80° C.

Cell-Based Assay.

Frozen CHO cells stably expressing CD32a (Fc gamma RITA) were thawed rapidly in a 37° C. water bath, and placed into CHO medium (RPMI 1640 Medium with 10% fetal bovine serum, L-Glutamine, Non-Essential Amino Acids, Sodium Pyruvate, and penicillin/Streptomycin). Cells were seeded at $1\times10^4$ cells/well (100 μL/well) in a 96-well assay plate (Costar, catalog no. 3603) and incubated for 24 hours at 37° C. in 5% $CO_2$ atmosphere. Labelled Tau monomers and fibrils were thawed on ice and diluted to concentrations of 1.5 μg/mL or 0.5 μg/mL respectively in assay buffer (RPMI 1640 media) (GIBCO, catalog no. 21875-034). Then, in a total volume of 60 μL, 7G6-HCzu25-LCzu18 antibody (final concentrations: 0.3 or 3 μg/mL), human IgG1 isotype control (BioXcell, catalog no. BE0297) (final concentration: 3 μg/mL) or vehicle (25 mM sodium phosphate buffer, pH 6.5, containing 150 mM NaCl) were added to either form of the protein and incubated at room temperature for one hour protected from light. CHO medium was removed from the plates and cells were pre-treated with 90 μl of assay buffer or a polyclonal antibody Fc receptor binding inhibitor (ThermoFisher Scientific, catalog no. 16-9161-71) diluted to 100 μg/mL also in assay buffer. Cells were then incubated for 30 min at 37° C. in 5% $CO_2$ atmosphere. Next, relevant wells received 10 μL of labelled Tau monomer or Tau fibril mixtures with or without antibody and plates were incubated for a further 60 minutes again at 37° C. in a 5% $CO_2$ atmosphere. Each treatment was performed in quintuplicate wells. Six independent experiments were performed for Tau monomer uptake assays and five independent experiments were completed to measure Tau fibril uptake.

Cell Fixation and Staining.

Following the final incubation period, cells were fixed in 4% paraformaldehyde for 30 min at room temperature. Each well was then washed with 100 μL of water and replaced by 70 μL of Hoechst staining buffer (Triton X-100 solution (final concentration: 0.2%) and Hoechst solution (final concentration: 0.02%)). The plate was covered and incubated for 30 minutes at room temperature with protection from light. The staining buffer was then removed and each well was washed twice more with 100 μL of water.

Cell Imaging.

Fluorescence images of each well were obtained using a Cellomics high content imaging system (ThermoFisherScientific). The total intensity of labelled Tau and the number of Hoechst positive cells in each well were recorded and analysed using the Thermo Scientific HCS Studio (ThermoFisherScientific) software.

Data Analysis. The mean of total intensity of Tau signal per cell was measured and the Tau uptake effect was calculated using the following formulas in the TIBCO spotfire software program:

Tau uptake effect (% of control)=$T_1/C_1\times100$, where $T_1$: Total intensity of DyLight 488 NHS conjugated Tau signal per cells in the antibody treated sample, and $C_1$: Total intensity of DyLight 488 NHS conjugated Tau signal per cells in the 7G6-HCzu25-LCzu18 (30 μg/mL) treated sample.

Statistical Analysis.

Data are expressed as the mean±SEM. Statistical analyses were performed using ONE-Way ANOVA test in the GraphPad Prism version 7.02 (GraphPad Software) ** $p<0.0001$,  $p<0.01$, * $p<0.05$.

Figure 33A:
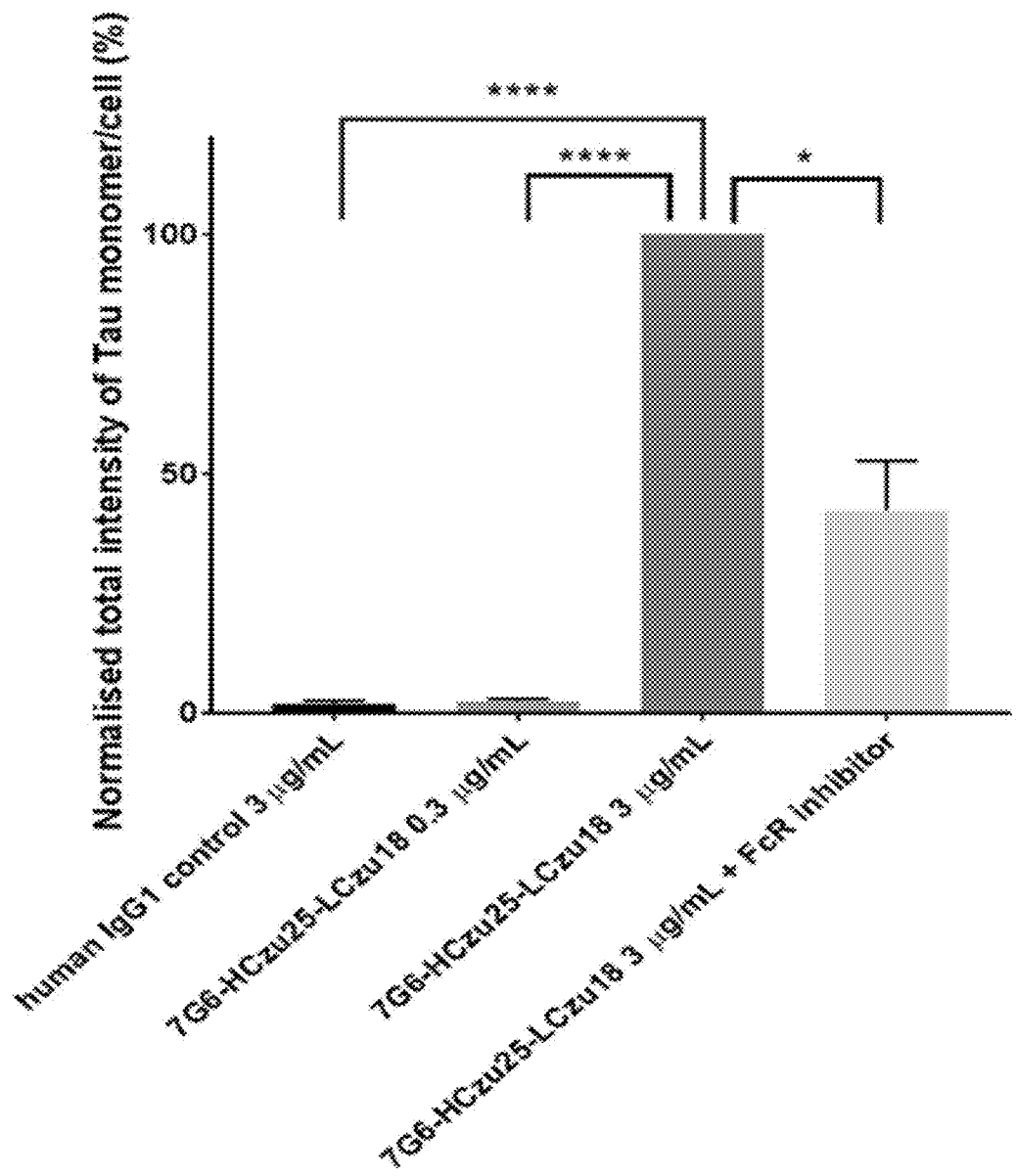
FIGS. 33A and 33B show the efficacy of Tau monomer or fibril uptake, respectively, in CHO cells overexpressing CD32A. 7G6-HCzu25-LCzu18 antibody (3 µg/mL) significantly increased Tau monomer uptake compared to human IgG1 control (3 µg/mL) (FIG. 33A). Likewise, 7G6-HCzu25-LCzu18 antibody (0.3 and 3 µg/mL) also significantly increased Tau fibril uptake compared to human IgG1 control (3 µg/mL) (FIG. 33B). In both cases, FcR inhibitor treatment significantly blocked the effect of 7G6-HCzu25-LCzu18 antibody-induced Tau uptake in this cell assay system.
Figure 33B:
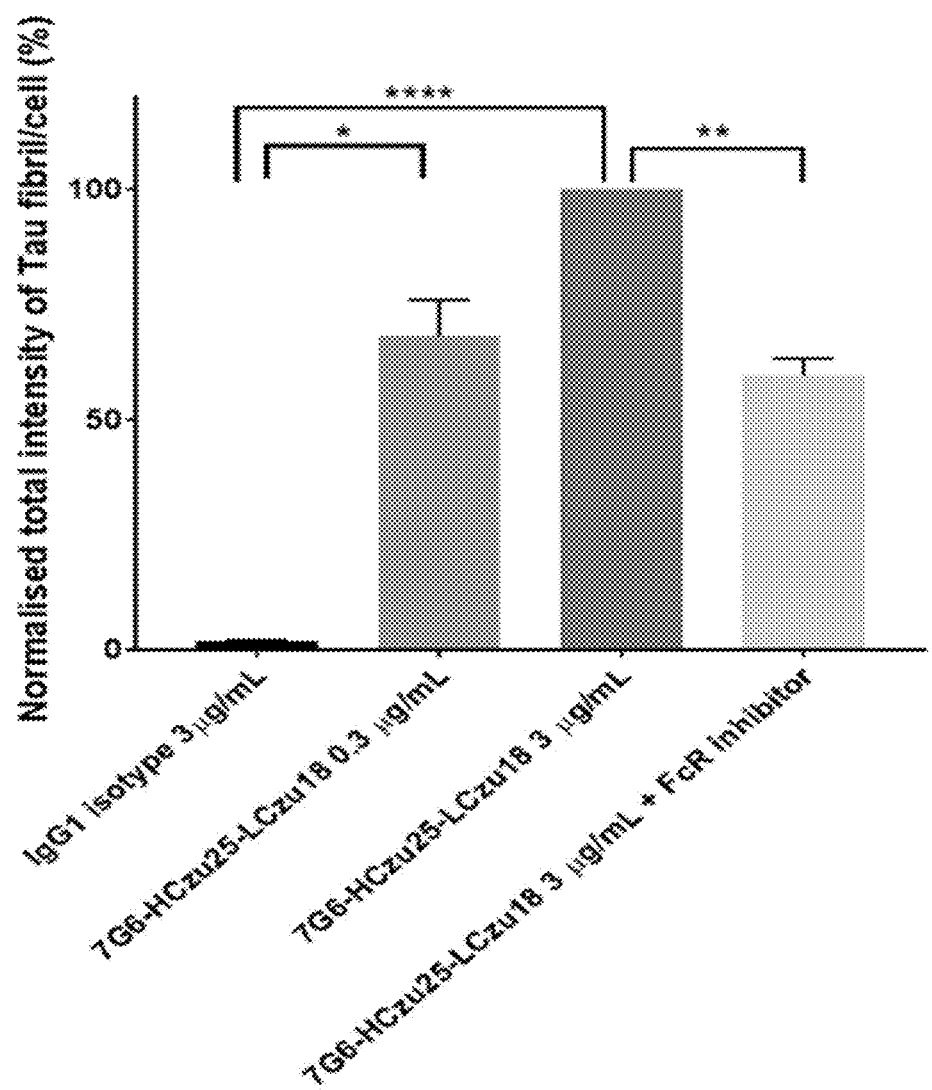

FIGS. 33A and 33B show the efficacy of Tau monomer or fibril uptake, respectively, in CHO cells overexpressing CD32 Å. 7G6-HCzu25-LCzu18 antibody (3 μg/mL) significantly increased Tau monomer uptake compared to human IgG1 control (3 μg/mL) (FIG. 33A). Likewise, 7G6-HCzu25-LCzu18 antibody (0.3 and 3 μg/mL) also significantly increased Tau fibril uptake compared to human IgG1 control (3 μg/mL) (FIG. 33B). In both cases, FcR inhibitor treatment significantly blocked the effect of 7G6-HCzu25-LCzu18 antibody-induced Tau uptake in this cell assay system.

SEQUENCE LISTING (1207 sequences)

SEQ ID NO: 1 - protein, 15 aa, Artificial Sequence
  Description of Artificial Sequence: Synthetic peptide
GSGSGSGMAEPRQEF

SEQ ID NO: 2 - protein, 15 aa, Artificial Sequence
  Description of Artificial Sequence: Synthetic peptide
QEFEVMEDHAGTYGL

SEQ ID NO: 3 - protein, 15 aa, Artificial Sequence
  Description of Artificial Sequence: Synthetic peptide
YGLGDRKDQGGYTMH

SEQ ID NO: 4 - protein, 15 aa, Artificial Sequence
  Description of Artificial Sequence: Synthetic peptide
TMHQDQEGDTDAGLK

SEQ ID NO: 5 - protein, 15 aa, Artificial Sequence
  Description of Artificial Sequence: Synthetic peptide
GLKESPLQTPTEDGS

SEQ ID NO: 6 - protein, 15 aa, Artificial Sequence
  Description of Artificial Sequence: Synthetic peptide
DGSEEPGSETSDAKS

SEQ ID NO: 7 - protein, 15 aa, Artificial Sequence
  Description of Artificial Sequence: Synthetic peptide
AKSTPTAEDVTAPLV

SEQ ID NO: 8 - protein, 15 aa, Artificial Sequence
  Description of Artificial Sequence: Synthetic peptide
PLVDEGAPGKQAAAQ

SEQ ID NO: 9 - protein, 15 aa, Artificial Sequence
  Description of Artificial Sequence: Synthetic peptide
AAQPHTEIPEGTTAE

SEQ ID NO: 10 - protein, 15 aa, Artificial Sequence
  Description of Artificial Sequence: Synthetic peptide
TAEEAGIGDTPSLED

SEQ ID NO: 11 - protein, 15 aa, Artificial Sequence
  Description of Artificial Sequence: Synthetic peptide
LEDEAAGHVTQARMV

SEQ ID NO: 12 - protein, 15 aa, Artificial Sequence
  Description of Artificial Sequence: Synthetic peptide
RMVSKSKDGTGSDDK

SEQ ID NO: 13 - protein, 15 aa, Artificial Sequence
  Description of Artificial Sequence: Synthetic peptide
DDKKAKGADGKTKIA

SEQ ID NO: 14 - protein, 15 aa, Artificial Sequence
  Description of Artificial Sequence: Synthetic peptide
KIATPRGAAPPGQKG

SEQ ID NO: 15 - protein, 15 aa, Artificial Sequence
  Description of Artificial Sequence: Synthetic peptide
QKGQANATRIPAKTP

SEQ ID NO: 16 - protein, 15 aa, Artificial Sequence
  Description of Artificial Sequence: Synthetic peptide
KTPPAPKTPPSSGEP

SEQ ID NO: 17 - protein, 15 aa, Artificial Sequence
  Description of Artificial Sequence: Synthetic peptide
GEPPKSGDRSGYSSP

SEQ ID NO: 18 - protein, 15 aa, Artificial Sequence
  Description of Artificial Sequence: Synthetic peptide
SSPGSPGTPGSRSRT

SEQ ID NO: 19 - protein, 15 aa, Artificial Sequence
  Description of Artificial Sequence: Synthetic peptide
SRTPSLPTPPTREPK

SEQ ID NO: 20 - protein, 15 aa, Artificial Sequence
  Description of Artificial Sequence: Synthetic peptide
EPKKVAVVRTPPKSP

SEQ ID NO: 21 - protein, 15 aa, Artificial Sequence
  Description of Artificial Sequence: Synthetic peptide
KSPSSAKSRLQTAPV

SEQ ID NO: 22 - protein, 15 aa, Artificial Sequence
  Description of Artificial Sequence: Synthetic peptide
APVPMPDLKNVKSKI

SEQ ID NO: 23 - protein, 15 aa, Artificial Sequence
  Description of Artificial Sequence: Synthetic peptide
SKIGSTENLKHQPGG

SEQ ID NO: 24 - protein, 15 aa, Artificial Sequence
  Description of Artificial Sequence: Synthetic peptide
PGGGKVQIINKKLDL

SEQ ID NO: 25 - protein, 15 aa, Artificial Sequence
  Description of Artificial Sequence: Synthetic peptide
LDLSNVQSKCGSKDN

SEQ ID NO: 26 - protein, 15 aa, Artificial Sequence
  Description of Artificial Sequence: Synthetic peptide
KDNIKHVPGGGSVQI

SEQ ID NO: 27 - protein, 15 aa, Artificial Sequence
  Description of Artificial Sequence: Synthetic peptide
VQIVYKPVDLSKVTS

SEQ ID NO: 28 - protein, 15 aa, Artificial Sequence
  Description of Artificial Sequence: Synthetic peptide
VTSKCGSLGNIHHKP

SEQ ID NO: 29 - protein, 15 aa, Artificial Sequence
  Description of Artificial Sequence: Synthetic peptide
HKPGGGQVEVKSEKL

SEQ ID NO: 30 - protein, 15 aa, Artificial Sequence
  Description of Artificial Sequence: Synthetic peptide
EKLDFKDRVQSKIGS

SEQ ID NO: 31 - protein, 15 aa, Artificial Sequence
  Description of Artificial Sequence: Synthetic peptide
IGSLDNITHVPGGGN

SEQ ID NO: 32 - protein, 15 aa, Artificial Sequence
  Description of Artificial Sequence: Synthetic peptide
GGNKKIETHKLTFRE

SEQ ID NO: 33 - protein, 15 aa, Artificial Sequence
  Description of Artificial Sequence: Synthetic peptide
FRENAKAKTDHGAEI

SEQ ID NO: 34 - protein, 15 aa, Artificial Sequence
  Description of Artificial Sequence: Synthetic peptide
AEIVYKSPVVSGDTS

SEQ ID NO: 35 - protein, 15 aa, Artificial Sequence
  Description of Artificial Sequence: Synthetic peptide
DTSPRHLSNVSSTGS

SEQ ID NO: 36 - protein, 15 aa, Artificial Sequence
  Description of Artificial Sequence: Synthetic peptide
TGSIDMVDSPQLATL

SEQ ID NO: 37 - protein, 15 aa, Artificial Sequence
  Description of Artificial Sequence: Synthetic peptide
ATLADEVSASLAKQG

SEQ ID NO: 38 - protein, 15 aa, Artificial Sequence
  Description of Artificial Sequence: Synthetic peptide
KDNIKHVPGGGSVQA

SEQ ID NO: 39 - protein, 15 aa, Artificial Sequence
  Description of Artificial Sequence: Synthetic peptide
KDNIKHVPGGGSVQK

SEQ ID NO: 40 - protein, 15 aa, Artificial Sequence
  Description of Artificial Sequence: Synthetic peptide
KDNIKHVPGGGSVQS

SEQ ID NO: 41 - protein, 15 aa, Artificial Sequence
  Description of Artificial Sequence: Synthetic peptide
KDNIKHVPGGGSVDI

SEQ ID NO: 42 - protein, 15 aa, Artificial Sequence
  Description of Artificial Sequence: Synthetic peptide
KDNIKHVPGGGSVLI

SEQ ID NO: 43 - protein, 15 aa, Artificial Sequence
  Description of Artificial Sequence: Synthetic peptide
KDNIKHVPGGGSVVI

SEQ ID NO: 44 - protein, 15 aa, Artificial Sequence
  Description of Artificial Sequence: Synthetic peptide
KDNIKHVPGGGSFQI

SEQ ID NO: 45 - protein, 15 aa, Artificial Sequence
  Description of Artificial Sequence: Synthetic peptide
KDNIKHVPGGGSNQI

SEQ ID NO: 46 - protein, 15 aa, Artificial Sequence
  Description of Artificial Sequence: Synthetic peptide
KDNIKHVPGGGSYQI

SEQ ID NO: 47 - protein, 15 aa, Artificial Sequence
  Description of Artificial Sequence: Synthetic peptide
KDNIKHVPGGGHVQI

SEQ ID NO: 48 - protein, 15 aa, Artificial Sequence
  Description of Artificial Sequence: Synthetic peptide
KDNIKHVPGGGQVQI

SEQ ID NO: 49 - protein, 15 aa, Artificial Sequence
  Description of Artificial Sequence: Synthetic peptide
KDNIKHVPGGCSVQI

SEQ ID NO: 50 - protein, 15 aa, Artificial Sequence
  Description of Artificial Sequence: Synthetic peptide
KDNIKHVPGGLSVQI

SEQ ID NO: 51 - protein, 15 aa, Artificial Sequence
  Description of Artificial Sequence: Synthetic peptide
KDNIKHVPGGTSVQI

SEQ ID NO: 52 - protein, 15 aa, Artificial Sequence
  Description of Artificial Sequence: Synthetic peptide
KDNIKHVPGEGSVQI

SEQ ID NO: 53 - protein, 15 aa, Artificial Sequence
  Description of Artificial Sequence: Synthetic peptide
KDNIKHVPGNGSVQI

SEQ ID NO: 54 - protein, 15 aa, Artificial Sequence
  Description of Artificial Sequence: Synthetic peptide
KDNIKHVPGWGSVQI

SEQ ID NO: 55 - protein, 15 aa, Artificial Sequence
  Description of Artificial Sequence: Synthetic peptide
KDNIKHVPHGGSVQI

SEQ ID NO: 56 - protein, 15 aa, Artificial Sequence
  Description of Artificial Sequence: Synthetic peptide
KDNIKHVPQGGSVQI

SEQ ID NO: 57 - protein, 15 aa, Artificial Sequence
  Description of Artificial Sequence: Synthetic peptide
KDNIKHVAGGGSVQI

SEQ ID NO: 58 - protein, 15 aa, Artificial Sequence
  Description of Artificial Sequence: Synthetic peptide
KDNIKHVIGGGSVQI

SEQ ID NO: 59 - protein, 15 aa, Artificial Sequence
  Description of Artificial Sequence: Synthetic peptide
KDNIKHVSGGGSVQI

SEQ ID NO: 60 - protein, 15 aa, Artificial Sequence
  Description of Artificial Sequence: Synthetic peptide
KDNIKHDPGGGSVQI

SEQ ID NO: 61 - protein, 15 aa, Artificial Sequence
  Description of Artificial Sequence: Synthetic peptide
KDNIKHLPGGGSVQI

SEQ ID NO: 62 - protein, 15 aa, Artificial Sequence
  Description of Artificial Sequence: Synthetic peptide
KDNIKHTPGGGSVQI

SEQ ID NO: 63 - protein, 15 aa, Artificial Sequence
  Description of Artificial Sequence: Synthetic peptide
KDNIKFVPGGGSVQI

SEQ ID NO: 64 - protein, 15 aa, Artificial Sequence
  Description of Artificial Sequence: Synthetic peptide
KDNIKPVPGGGSVQI

SEQ ID NO: 65 - protein, 15 aa, Artificial Sequence
  Description of Artificial Sequence: Synthetic peptide
KDNIKYVPGGGSVQI

SEQ ID NO: 66 - protein, 15 aa, Artificial Sequence
  Description of Artificial Sequence: Synthetic peptide
KDNIHHVPGGGSVQI

SEQ ID NO: 67 - protein, 15 aa, Artificial Sequence
  Description of Artificial Sequence: Synthetic peptide
KDNIRHVPGGGSVQI

SEQ ID NO: 68 - protein, 15 aa, Artificial Sequence
  Description of Artificial Sequence: Synthetic peptide
KDNCKHVPGGGSVQI

SEQ ID NO: 69 - protein, 15 aa, Artificial Sequence
  Description of Artificial Sequence: Synthetic peptide
KDNLKHVPGGGSVQI

SEQ ID NO: 70 - protein, 15 aa, Artificial Sequence
  Description of Artificial Sequence: Synthetic peptide
KDNTKHVPGGGSVQI

SEQ ID NO: 71 - protein, 15 aa, Artificial Sequence
  Description of Artificial Sequence: Synthetic peptide
KDEIKHVPGGGSVQI

SEQ ID NO: 72 - protein, 15 aa, Artificial Sequence
  Description of Artificial Sequence: Synthetic peptide
KDMIKHVPGGGSVQI

SEQ ID NO: 73 - protein, 15 aa, Artificial Sequence
  Description of Artificial Sequence: Synthetic peptide
KDWIKHVPGGGSVQI

SEQ ID NO: 74 - protein, 15 aa, Artificial Sequence
  Description of Artificial Sequence: Synthetic peptide
KGNIKHVPGGGSVQI

SEQ ID NO: 75 - protein, 15 aa, Artificial Sequence
  Description of Artificial Sequence: Synthetic peptide
KPNIKHVPGGGSVQI

SEQ ID NO: 76 - protein, 15 aa, Artificial Sequence
  Description of Artificial Sequence: Synthetic peptide
KYNIKHVPGGGSVQI

SEQ ID NO: 77 - protein, 15 aa, Artificial Sequence
  Description of Artificial Sequence: Synthetic peptide
HDNIKHVPGGGSVQI

SEQ ID NO: 78 - protein, 15 aa, Artificial Sequence
  Description of Artificial Sequence: Synthetic peptide
RDNIKHVPGGGSVQI

SEQ ID NO: 79 - protein, 5 aa, Homo sapiens
HVPGG

SEQ ID NO: 80 - protein, 9 aa, Artificial Sequence
  Description of Artificial Sequence: Synthetic peptide
VQLVQSGAE

SEQ ID NO: 81 - protein, 9 aa, Artificial Sequence
  Description of Artificial Sequence: Synthetic peptide
LVQSGAEVK

SEQ ID NO: 82 - protein, 9 aa, Artificial Sequence
  Description of Artificial Sequence: Synthetic peptide
VKVSCKASG

SEQ ID NO: 83 - protein, 9 aa, Artificial Sequence
  Description of Artificial Sequence: Synthetic peptide
YWITWVRQA

SEQ ID NO: 84 - protein, 9 aa, Artificial Sequence
  Description of Artificial Sequence: Synthetic peptide
WVRQAPGQG

SEQ ID NO: 85 - protein, 9 aa, Artificial Sequence
  Description of Artificial Sequence: Synthetic peptide
VRQAPGQGL

SEQ ID NO: 86 - protein, 9 aa, Artificial Sequence
  Description of Artificial Sequence: Synthetic peptide
WMGDIYPGS

SEQ ID NO: 87 - protein, 9 aa, Artificial Sequence
  Description of Artificial Sequence: Synthetic peptide
ISNYAQKFQ

SEQ ID NO: 88 - protein, 9 aa, Artificial Sequence
  Description of Artificial Sequence: Synthetic peptide
FQGRVTMTR

SEQ ID NO: 89 - protein, 9 aa, Artificial Sequence
  Description of Artificial Sequence: Synthetic peptide
MTRDTSTST

SEQ ID NO: 90 - protein, 9 aa, Artificial Sequence
  Description of Artificial Sequence: Synthetic peptide
VYMELSSLR

SEQ ID NO: 91 - protein, 9 aa, Artificial Sequence
  Description of Artificial Sequence: Synthetic peptide
YMELSSLRS

SEQ ID NO: 92 - protein, 9 aa, Artificial Sequence
  Description of Artificial Sequence: Synthetic peptide
LRSEDTAVY

SEQ ID NO: 93 - protein, 9 aa, Artificial Sequence
  Description of Artificial Sequence: Synthetic peptide
VYYCAREDG

SEQ ID NO: 94 - protein, 9 aa, Artificial Sequence
  Description of Artificial Sequence: Synthetic peptide
YWGQGTLVT

SEQ ID NO: 95 - protein, 9 aa, Artificial Sequence
  Description of Artificial Sequence: Synthetic peptide
VQLLESGGG

SEQ ID NO: 96 - protein, 9 aa, Artificial Sequence
  Description of Artificial Sequence: Synthetic peptide
VQPGGSLRL

SEQ ID NO: 97 - protein, 9 aa, Artificial Sequence
  Description of Artificial Sequence: Synthetic peptide
LRLSCAASG

SEQ ID NO: 98 - protein, 9 aa, Artificial Sequence
  Description of Artificial Sequence: Synthetic peptide
YWITWVRQA

SEQ ID NO: 99 - protein, 9 aa, Artificial Sequence
  Description of Artificial Sequence: Synthetic peptide
WVRQAPGKG

SEQ ID NO: 100 - protein, 9 aa, Artificial Sequence
  Description of Artificial Sequence: Synthetic peptide
VRQAPGKGL

SEQ ID NO: 101 - protein, 9 aa, Artificial Sequence
  Description of Artificial Sequence: Synthetic peptide
WVSDIYPGS

SEQ ID NO: 102 - protein, 9 aa, Artificial Sequence
  Description of Artificial Sequence: Synthetic peptide
YNEKFKSRF

SEQ ID NO: 103 - protein, 9 aa, Artificial Sequence
  Description of Artificial Sequence: Synthetic peptide
FKSRFTISV

SEQ ID NO: 104 - protein, 9 aa, Artificial Sequence
  Description of Artificial Sequence: Synthetic peptide
FTISVDNSK

SEQ ID NO: 105 - protein, 9 aa, Artificial Sequence
  Description of Artificial Sequence: Synthetic peptide
LYLQMNSLR

SEQ ID NO: 106 - protein, 9 aa, Artificial Sequence
  Description of Artificial Sequence: Synthetic peptide
YLQMNSLRA

SEQ ID NO: 107 - protein, 9 aa, Artificial Sequence
  Description of Artificial Sequence: Synthetic peptide
LQMNSLRAE

SEQ ID NO: 108 - protein, 9 aa, Artificial Sequence
  Description of Artificial Sequence: Synthetic peptide
MNSLRAEDT

SEQ ID NO: 109 - protein, 9 aa, Artificial Sequence
  Description of Artificial Sequence: Synthetic peptide
LRAEDTAVY

SEQ ID NO: 110 - protein, 9 aa, Artificial Sequence
  Description of Artificial Sequence: Synthetic peptide
VYYCAREDG

SEQ ID NO: 111 - protein, 9 aa, Artificial Sequence
  Description of Artificial Sequence: Synthetic peptide
YWGQGTLVT

SEQ ID NO: 112 - protein, 9 aa, Artificial Sequence
  Description of Artificial Sequence: Synthetic peptide
VVMTQSPLS

SEQ ID NO: 113 - protein, 9 aa, Artificial Sequence
  Description of Artificial Sequence: Synthetic peptide
VMTQSPLSL

SEQ ID NO: 114 - protein, 9 aa, Artificial Sequence
  Description of Artificial Sequence: Synthetic peptide
LSLPVTLGQ

SEQ ID NO: 115 - protein, 9 aa, Artificial Sequence
  Description of Artificial Sequence: Synthetic peptide
VTLGQPASI

SEQ ID NO: 116 - protein, 9 aa, Artificial Sequence
  Description of Artificial Sequence: Synthetic peptide
ILHSNGNTY

SEQ ID NO: 117 - protein, 9 aa, Artificial Sequence
  Description of Artificial Sequence: Synthetic peptide
LHSNGNTYL

SEQ ID NO: 118 - protein, 9 aa, Artificial Sequence
  Description of Artificial Sequence: Synthetic peptide
WYQQRPGQS

SEQ ID NO: 119 - protein, 9 aa, Artificial Sequence
  Description of Artificial Sequence: Synthetic peptide
LLISKVSNR

SEQ ID NO: 120 - protein, 9 aa, Artificial Sequence
  Description of Artificial Sequence: Synthetic peptide
LISKVSNRF

SEQ ID NO: 121 - protein, 9 aa, Artificial Sequence
  Description of Artificial Sequence: Synthetic peptide
FTLKISRVE

SEQ ID NO: 122 - protein, 9 aa, Artificial Sequence
  Description of Artificial Sequence: Synthetic peptide
LKISRVEAE

SEQ ID NO: 123 - protein, 9 aa, Artificial Sequence
  Description of Artificial Sequence: Synthetic peptide
ISRVEAEDV

SEQ ID NO: 124 - protein, 9 aa, Artificial Sequence
  Description of Artificial Sequence: Synthetic peptide
VGVYYCFQG

SEQ ID NO: 125 - protein, 9 aa, Artificial Sequence
  Description of Artificial Sequence: Synthetic peptide
VYYCFQGSH

SEQ ID NO: 126 - protein, 9 aa, Artificial Sequence
  Description of Artificial Sequence: Synthetic peptide
YYCFQGSHV

SEQ ID NO: 127 - protein, 9 aa, Artificial Sequence
  Description of Artificial Sequence: Synthetic peptide
YCFQGSHVP

SEQ ID NO: 128 - protein, 9 aa, Artificial Sequence
  Description of Artificial Sequence: Synthetic peptide
FQGSHVPFT

SEQ ID NO: 129 - protein, 9 aa, Artificial Sequence
  Description of Artificial Sequence: Synthetic peptide
FTFGQGTKL

SEQ ID NO: 130 - protein, 9 aa, Artificial Sequence
  Description of Artificial Sequence: Synthetic peptide
FGQGTKLEI

SEQ ID NO: 131 - protein, 9 aa, Artificial Sequence
  Description of Artificial Sequence: Synthetic peptide
VVMTQSPLS

SEQ ID NO: 132 - protein, 9 aa, Artificial Sequence
  Description of Artificial Sequence: Synthetic peptide
VMTQSPLSL

SEQ ID NO: 133 - protein, 9 aa, Artificial Sequence
  Description of Artificial Sequence: Synthetic peptide
LSLPVTLGQ

SEQ ID NO: 134 - protein, 9 aa, Artificial Sequence
  Description of Artificial Sequence: Synthetic peptide
VTLGQPASI

SEQ ID NO: 135 - protein, 9 aa, Artificial Sequence
  Description of Artificial Sequence: Synthetic peptide
ILHSNGNTY

SEQ ID NO: 136 - protein, 9 aa, Artificial Sequence
  Description of Artificial Sequence: Synthetic peptide
LHSNGNTYL

SEQ ID NO: 137 - protein, 9 aa, Artificial Sequence
  Description of Artificial Sequence: Synthetic peptide
LEWFQQRPG

SEQ ID NO: 138 - protein, 9 aa, Artificial Sequence
  Description of Artificial Sequence: Synthetic peptide
WFQQRPGQS

SEQ ID NO: 139 - protein, 9 aa, Artificial Sequence
  Description of Artificial Sequence: Synthetic peptide
LLISKVSNR

SEQ ID NO: 140 - protein, 9 aa, Artificial Sequence
  Description of Artificial Sequence: Synthetic peptide
LISKVSNRF

SEQ ID NO: 141 - protein, 9 aa, Artificial Sequence
  Description of Artificial Sequence: Synthetic peptide
FTLKISRVE

SEQ ID NO: 142 - protein, 9 aa, Artificial Sequence
  Description of Artificial Sequence: Synthetic peptide
LKISRVEAE

SEQ ID NO: 143 - protein, 9 aa, Artificial Sequence
  Description of Artificial Sequence: Synthetic peptide
ISRVEAEDV

SEQ ID NO: 144 - protein, 9 aa, Artificial Sequence
  Description of Artificial Sequence: Synthetic peptide
VGVYYCFQG

SEQ ID NO: 145 - protein, 9 aa, Artificial Sequence
  Description of Artificial Sequence: Synthetic peptide
VYYCFQGSH

SEQ ID NO: 146 - protein, 9 aa, Artificial Sequence
  Description of Artificial Sequence: Synthetic peptide
YYCFQGSHV

SEQ ID NO: 147 - protein, 9 aa, Artificial Sequence
  Description of Artificial Sequence: Synthetic peptide
YCFQGSHVP

SEQ ID NO: 148 - protein, 9 aa, Artificial Sequence
  Description of Artificial Sequence: Synthetic peptide
FQGSHVPFT

SEQ ID NO: 149 - protein, 9 aa, Artificial Sequence
  Description of Artificial Sequence: Synthetic peptide
FTFGQGTKL

SEQ ID NO: 150 - protein, 9 aa, Artificial Sequence
  Description of Artificial Sequence: Synthetic peptide
FGQGTKLEI

SEQ ID NO: 151 - protein, 9 aa, Artificial Sequence
  Description of Artificial Sequence: Synthetic peptide
VQMTQSPSS

SEQ ID NO: 152 - protein, 9 aa, Artificial Sequence
  Description of Artificial Sequence: Synthetic peptide
MTQSPSSLS

SEQ ID NO: 153 - protein, 9 aa, Artificial Sequence
  Description of Artificial Sequence: Synthetic peptide
ILHSNGNTY

SEQ ID NO: 154 - protein, 9 aa, Artificial Sequence
  Description of Artificial Sequence: Synthetic peptide
LHSNGNTYL

SEQ ID NO: 155 - protein, 9 aa, Artificial Sequence
  Description of Artificial Sequence: Synthetic peptide
WYQQKPGKA

SEQ ID NO: 156 - protein, 9 aa, Artificial Sequence
  Description of Artificial Sequence: Synthetic peptide
LLISKVSNR

SEQ ID NO: 157 - protein, 9 aa, Artificial Sequence
  Description of Artificial Sequence: Synthetic peptide
LISKVSNRF

SEQ ID NO: 158 - protein, 9 aa, Artificial Sequence
  Description of Artificial Sequence: Synthetic peptide
FSGVPSRFS

SEQ ID NO: 159 - protein, 9 aa, Artificial Sequence
  Description of Artificial Sequence: Synthetic peptide
FTLTISSLQ

SEQ ID NO: 160 - protein, 9 aa, Artificial Sequence
  Description of Artificial Sequence: Synthetic peptide
FATYYCFQG

SEQ ID NO: 161 - protein, 9 aa, Artificial Sequence
  Description of Artificial Sequence: Synthetic peptide
YYCFQGSHV

SEQ ID NO: 162 - protein, 9 aa, Artificial Sequence
  Description of Artificial Sequence: Synthetic peptide
YCFQGSHVP

SEQ ID NO: 163 - protein, 9 aa, Artificial Sequence
  Description of Artificial Sequence: Synthetic peptide
FQGSHVPFT

SEQ ID NO: 164 - protein, 9 aa, Artificial Sequence
  Description of Artificial Sequence: Synthetic peptide
FTFGQGTKL

SEQ ID NO: 165 - protein, 9 aa, Artificial Sequence
  Description of Artificial Sequence: Synthetic peptide
FGQGTKLEI

SEQ ID NO: 166 - protein, 9 aa, Artificial Sequence
  Description of Artificial Sequence: Synthetic peptide
IQMTQSPSS

SEQ ID NO: 167 - protein, 9 aa, Artificial Sequence
  Description of Artificial Sequence: Synthetic peptide
MTQSPSSLS

SEQ ID NO: 168 - protein, 9 aa, Artificial Sequence
  Description of Artificial Sequence: Synthetic peptide
ILHSNGNTY

SEQ ID NO: 169 - protein, 9 aa, Artificial Sequence
  Description of Artificial Sequence: Synthetic peptide
LHSNGNTYL

SEQ ID NO: 170 - protein, 9 aa, Artificial Sequence
  Description of Artificial Sequence: Synthetic peptide
WYQQKPGKA

SEQ ID NO: 171 - protein, 9 aa, Artificial Sequence
  Description of Artificial Sequence: Synthetic peptide
LLISKVSNR

SEQ ID NO: 172 - protein, 9 aa, Artificial Sequence
  Description of Artificial Sequence: Synthetic peptide
LISKVSNRF

SEQ ID NO: 173 - protein, 9 aa, Artificial Sequence
  Description of Artificial Sequence: Synthetic peptide
FSGVPSRFS

SEQ ID NO: 174 - protein, 9 aa, Artificial Sequence
  Description of Artificial Sequence: Synthetic peptide
FTLTISSLQ

SEQ ID NO: 175 - protein, 9 aa, Artificial Sequence
  Description of Artificial Sequence: Synthetic peptide
FATYYCFQG

SEQ ID NO: 176 - protein, 9 aa, Artificial Sequence
  Description of Artificial Sequence: Synthetic peptide
YYCFQGSHV

SEQ ID NO: 177 - protein, 9 aa, Artificial Sequence
  Description of Artificial Sequence: Synthetic peptide
YCFQGSHVP

SEQ ID NO: 178 - protein, 9 aa, Artificial Sequence
  Description of Artificial Sequence: Synthetic peptide
FQGSHVPFT

SEQ ID NO: 179 - protein, 9 aa, Artificial Sequence
  Description of Artificial Sequence: Synthetic peptide
FTFGQGTKL

SEQ ID NO: 180 - protein, 9 aa, Artificial Sequence
  Description of Artificial Sequence: Synthetic peptide
FGQGTKLEI

SEQ ID NO: 181 - protein, 441 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 182 - protein, 5 aa, Homo sapiens
HKPGG

SEQ ID NO: 183 - protein, 5 aa, Homo sapiens
HQPGG

SEQ ID NO: 184 - protein, 5 aa, Homo sapiens
HVSGG

SEQ ID NO: 185 - protein, 5 aa, Homo sapiens
HVLGG

SEQ ID NO: 186 - protein, 20 aa, Artificial Sequence
  Description of Artificial Sequence: Synthetic peptide
CNIKHVPGGGSVQIVYKPVD

SEQ ID NO: 187 - protein, 6 aa, Artificial Sequence
  Description of Artificial Sequence: Synthetic peptide
VQIVYK

SEQ ID NO: 188 - protein, 7 aa, Artificial Sequence
  Description of Artificial Sequence: Synthetic peptide
GSGSGSG

SEQ ID NO: 189 - protein, 10 aa, Influenza A virus
YPYDVPDYAG

SEQ ID NO: 190 - DNA, 509 bp, Artificial Sequence
  Description of Artificial Sequence: Synthetic polynucleotide
atgggatggagctgtatcatcctcattttggtagcagcagctacaggtgtccactcccaggtccaactgctgcagcctggggctgagcttgtgaagcctggggcttcagtaataatgtcctgcaaggcttctggctacaccttcaccacctactggataacctgggtgaagcagaggcctggacaaggccttgagtggattggagatatttatcctggtagtagtatttgtaactacaatgagaagttcaagagcaaggccacactgactgtagacacatcctccagcacagcctacatgcagctcaacagcctgacatctgaggactctgcggtctattactgtgcaagggaggatggttacgacgcctggtttgcttactggggccaagggactctggtcactgtctccgcagccaaaacaacacccccatcagtctatccactggcccctgggtgtggagatacaactggttcctctgtgactctgggatgcctggtcaagggcta

SEQ ID NO: 191 - DNA, 452 bp, Artificial Sequence
  Description of Artificial Sequence: Synthetic polynucleotide
caggtccaactgctgcagcctggggctgagcttgtgaagcctggggcttcagtaataatgtcctgcaaggcttctggctacaccttcaccacctactggataacctgggtgaagcagaggcctggacaaggccttgagtggattggagatatttatcctggtagtagtatttgtaactacaatgagaagttcaagagcaaggccacactgactgtagacacatcctccagcacagcctacatgcagctcaacagcctgacatctgaggactctgcggtctattactgtgcaagggaggatggttacgacgcctggtttgcttactggggccaagggactctggtcactgtctccgcagccaaaacaacacccccatcagtctatccactggcccctgggtgtggagatacaactggttcctctgtgactctgggatgcctggtcaagggcta

SEQ ID NO: 192 - protein, 169 aa, Artificial Sequence
  Description of Artificial Sequence: Synthetic polypeptide
MGWSCIILILVAAATGVHSQVQLLQPGAELVKPGASVIMSCKASGYTFTTYWITWVKQRPGQGLEWIGDIYPGSSICNYNEKFKSKATLTVDTSSSTAYMQLNSLTSEDSAVYYCAREDGYDAWFAYWGQGTLVTVSAAKTTPPSVYPLAPGCGDTTGSSVTLGCLVKG

SEQ ID NO: 193 - protein, 150 aa, Artificial Sequence
  Description of Artificial Sequence: Synthetic polypeptide
QVQLLQPGAELVKPGASVIMSCKASGYTFTTYWITWVKQRPGQGLEWIGDIYPGSSICNYNEKFKSKATLTVDTSSSTAYMQLNSLTSEDSAVYYCAREDGYDAWFAYWGQGTLVTVSAAKTTPPSVYPLAPGCGDTTGSSVTLGCLVKG

SEQ ID NO: 194 - DNA, 57 bp, Artificial Sequence
  Description of Artificial Sequence: Synthetic oligonucleotide
atgggatggagctgtatcatcctcattttggtagcagcagctacaggtgtccactcc

SEQ ID NO: 195 - DNA, 357 bp, Artificial Sequence
  Description of Artificial Sequence: Synthetic polynucleotide
caggtccaactgctgcagcctggggctgagcttgtgaagcctggggcttcagtaataatgtcctgcaaggcttctggctacaccttcaccacctactggataacctgggtgaagcagaggcctggacaaggccttgagtggattggagatatttatcctggtagtagtatttgtaactacaatgagaagttcaagagcaaggccacactgactgtagacacatcctccagcacagcctacatgcagctcaacagcctgacatctgaggactctgcggtctattactgtgcaagggaggatggttacgacgcctggtttgcttactggggccaagggactctggtcactgtctccgca

SEQ ID NO: 196 - protein, 119 aa, Artificial Sequence
  Description of Artificial Sequence: Synthetic polypeptide
QVQLLQPGAELVKPGASVIMSCKASGYTFTTYWITWVKQRPGQGLEWIGDIYPGSSICNYNEKFKSKATLTVDTSSSTAYMQLNSLTSEDSAVYYCAREDGYDAWFAYWGQGTLVTVSA

SEQ ID NO: 197 - DNA, 95 bp, Artificial Sequence
  Description of Artificial Sequence: Synthetic oligonucleotide
gccaaaacaacacccccatcagtctatccactggcccctgggtgtggagatacaactggttcctctgtgactctgggatgcctggtcaagggcta

SEQ ID NO: 198 - protein, 31 aa, Artificial Sequence
  Description of Artificial Sequence: Synthetic polypeptide
AKTTPPSVYPLAPGCGDTTGSSVTLGCLVKG

SEQ ID NO: 199 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 200 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 201 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSICNYNEKFKSRVTMTRDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYNEKFKSRVTMTRDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - DNA, 57 bp, Artificial Sequence
  Description of Artificial Sequence: Synthetic oligonucleotide
atgggctggtcctgcatcatcctgtttctggtggccaccgccaccggcgtgcacagc

SEQ ID NO: 204 - DNA, 414 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatct

SEQ ID NO: 205 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYNEKFKSRVTMTRDTSTSTVYMELSSLRSEDTAVYYCAREDGYDAWFAYWGQGTLVTVSS

SEQ ID NO: 206 - DNA, 987 bp, Artificial Sequence
  Description of Artificial Sequence: Synthetic polynucleotide
gcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccggg

SEQ ID NO: 207 - protein, 309 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCS

SEQ ID NO: 208 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 209 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 210 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSICNYNEKFKSRVTMTVDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYNEKFKSRVTMTVDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - DNA, 57 bp, Artificial Sequence; identical to SEQ ID NO: 203
  Description of Artificial Sequence: Synthetic oligonucleotide

SEQ ID NO: 213 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatct

SEQ ID NO: 214 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYNEKFKSRVTMTVDTSTSTVYMELSSLRSEDTAVYYCAREDGYDAWFAYWGQGTLVTVSS

SEQ ID NO: 215 - DNA, 987 bp, Artificial Sequence; identical to SEQ ID NO: 206
  Description of Artificial Sequence: Synthetic polynucleotide

SEQ ID NO: 216 - protein, 330 aa, Artificial Sequence [sequence omitted]

SEQ ID NO: 217 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 218 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 219 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSICNYNEKFKSRVTMTVDTSTSTAYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYNEKFKSRVTMTVDTSTSTAYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - DNA, 57 bp, Artificial Sequence; identical to SEQ ID NO: 203
  Description of Artificial Sequence: Synthetic oligonucleotide

SEQ ID NO: 222 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacaacgagaagttcaagtcccgcgtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatct

SEQ ID NO: 223 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYNEKFKSRVTMTVDTSTSTAYMELSSLRSEDTAVYYCAREDGYDAWFAYWGQGTLVTVSS

SEQ ID NO: 224 - DNA, 987 bp, Artificial Sequence; identical to SEQ ID NO: 206
  Description of Artificial Sequence: Synthetic polynucleotide

SEQ ID NO: 225 - protein, 330 aa, Artificial Sequence [sequence omitted]

SEQ ID NO: 226 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaaattccagggcagagtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 227 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaaattccagggcagagtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 228 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSICNYAQKFQGRVTMTVDTSTSTAYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYAQKFQGRVTMTVDTSTSTAYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - DNA, 57 bp, Artificial Sequence; identical to SEQ ID NO: 203
  Description of Artificial Sequence: Synthetic oligonucleotide

SEQ ID NO: 231 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaaattccagggcagagtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatct

SEQ ID NO: 232 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYAQKFQGRVTMTVDTSTSTAYMELSSLRSEDTAVYYCAREDGYDAWFAYWGQGTLVTVSS

SEQ ID NO: 233 - DNA, 987 bp, Artificial Sequence; identical to SEQ ID NO: 206
  Description of Artificial Sequence: Synthetic polynucleotide

SEQ ID NO: 234 - protein, 330 aa, Artificial Sequence [sequence omitted]

SEQ ID NO: 235 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacaacgagaagttcaagtcccgcgtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 236 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacaacgagaagttcaagtcccgcgtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 237 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSISNYNEKFKSRVTMTVDTSTSTAYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSISNYNEKFKSRVTMTVDTSTSTAYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - DNA, 57 bp, Artificial Sequence; identical to SEQ ID NO: 203
  Description of Artificial Sequence: Synthetic oligonucleotide

SEQ ID NO: 240 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacaacgagaagttcaagtcccgcgtgaccatgaccgtggacacctccaccagcaccgcctacatggaactgtcctccctgcggagcgaggacaccgccgtgtactactgcgctagagaggacggctacgacgcttggtttgcctactggggccagggcaccctcgtgaccgtgtcatct

SEQ ID NO: 241 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSISNYNEKFKSRVTMTVDTSTSTAYMELSSLRSEDTAVYYCAREDGYDAWFAYWGQGTLVTVSS

SEQ ID NO: 242 - DNA, 987 bp, Artificial Sequence; identical to SEQ ID NO: 206
  Description of Artificial Sequence: Synthetic polynucleotide

SEQ ID NO: 243 - protein, 330 aa, Artificial Sequence [sequence omitted]

SEQ ID NO: 244 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacaacgagaagttcaagtcccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 245 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacaacgagaagttcaagtcccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 246 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSISNYNEKFKSRVTMTVDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSISNYNEKFKSRVTMTVDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 248 - DNA, 57 bp, Artificial Sequence; identical to SEQ ID NO: 203
  Description of Artificial Sequence: Synthetic oligonucleotide

SEQ ID NO: 249 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacaacgagaagttcaagtcccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatct

SEQ ID NO: 250 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSISNYNEKFKSRVTMTVDTSTSTVYMELSSLRSEDTAVYYCAREDGYDAWFAYWGQGTLVTVSS

SEQ ID NO: 251 - DNA, 987 bp, Artificial Sequence; identical to SEQ ID NO: 206
  Description of Artificial Sequence: Synthetic polynucleotide

SEQ ID NO: 252 - protein, 330 aa, Artificial Sequence [sequence omitted]

SEQ ID NO: 253 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacgcccagaagttccagggccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 254 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacgcccagaagttccagggccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 255 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSISNYAQKFQGRVTMTVDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSISNYAQKFQGRVTMTVDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 257 - DNA, 57 bp, Artificial Sequence; identical to SEQ ID NO: 203
  Description of Artificial Sequence: Synthetic oligonucleotide

SEQ ID NO: 258 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacgcccagaagttccagggccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatct

SEQ ID NO: 259 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSISNYAQKFQGRVTMTVDTSTSTVYMELSSLRSEDTAVYYCAREDGYDAWFAYWGQGTLVTVSS

SEQ ID NO: 260 - DNA, 987 bp, Artificial Sequence; identical to SEQ ID NO: 206
  Description of Artificial Sequence: Synthetic polynucleotide

SEQ ID NO: 261 - protein, 330 aa, Artificial Sequence [sequence omitted]

SEQ ID NO: 262 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacgcccagaagttccagggccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 263 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacgcccagaagttccagggccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 264 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSISNYAQKFQGRVTMTRDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 265 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSISNYAQKFQGRVTMTRDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - DNA, 57 bp, Artificial Sequence; identical to SEQ ID NO: 203
  Description of Artificial Sequence: Synthetic oligonucleotide

SEQ ID NO: 267 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctccaactacgcccagaagttccagggccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatct

SEQ ID NO: 268 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSISNYAQKFQGRVTMTRDTSTSTVYMELSSLRSEDTAVYYCAREDGYDAWFAYWGQGTLVTVSS

SEQ ID NO: 269 - DNA, 987 bp, Artificial Sequence; identical to SEQ ID NO: 206
  Description of Artificial Sequence: Synthetic polynucleotide

SEQ ID NO: 270 - protein, 330 aa, Artificial Sequence [sequence omitted]

SEQ ID NO: 271 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaagttccagggccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 272 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaagttccagggccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 273 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSICNYAQKFQGRVTMTVDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 274 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYAQKFQGRVTMTVDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - DNA, 57 bp, Artificial Sequence; identical to SEQ ID NO: 203
  Description of Artificial Sequence: Synthetic oligonucleotide

SEQ ID NO: 276 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaagttccagggccgcgtgaccatgaccgtggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatct

SEQ ID NO: 277 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYAQKFQGRVTMTVDTSTSTVYMELSSLRSEDTAVYYCAREDGYDAWFAYWGQGTLVTVSS

SEQ ID NO: 278 - DNA, 987 bp, Artificial Sequence; identical to SEQ ID NO: 206
  Description of Artificial Sequence: Synthetic polynucleotide

SEQ ID NO: 279 - protein, 330 aa, Artificial Sequence [sequence omitted]

SEQ ID NO: 280 - DNA, 1407 bp, Artificial Sequence
  Description of Artificial Sequence: Synthetic polynucleotide
atgggctggtcctgcatcatcctgtttctggtggccaccgccaccggcgtgcacagccaggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaagttccagggccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 281 - DNA, 1350 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaagttccagggccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 282 - protein, 468 aa, Artificial Sequence
  Description of Artificial Sequence: Synthetic polypeptide
MGWSCIILFLVATATGVHSQVQLVQSGAEVKKPGASVKVSCKASGYTFTTYWITWVRQAPGQGLEWMGDIYPGSSICNYAQKFQGRVTMTRDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - protein, 449 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYAQKFQGRVTMTRDTSTSTVYMELSSLRSEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - DNA, 57 bp, Artificial Sequence; identical to SEQ ID NO: 203
  Description of Artificial Sequence: Synthetic oligonucleotide

SEQ ID NO: 285 - DNA, 357 bp, Artificial Sequence
  Description of Artificial Sequence: Synthetic polynucleotide
caggtgcagctggtgcagtctggcgccgaagtgaagaaacctggcgcctccgtgaaggtgtcctgcaaggcttccggctacacctttaccacctactggatcacctgggtgcgacaggctcctggacagggcctggaatggatgggcgacatctaccccggctcctccatctgcaactacgcccagaagttccagggccgcgtgaccatgacccgggacacctccaccagcaccgtgtacatggaactgtcctccctgcggagcgaggacaccgccgtgtactactgcgctagagaggacggctacgacgcttggtttgcctactggggccagggcaccctcgtgaccgtgtcatct

SEQ ID NO: 286 - protein, 119 aa, Artificial Sequence
  Description of Artificial Sequence: Synthetic polypeptide
QVQLVQSGAEVKKPGASVKVSCKASGYTFTTYWITWVRQAPGQGLEWMGDIYPGSSICNYAQKFQGRVTMTRDTSTSTVYMELSSLRSEDTAVYYCAREDGYDAWFAYWGQGTLVTVSS

SEQ ID NO: 287 - DNA, 987 bp, Artificial Sequence; identical to SEQ ID NO: 206
  Description of Artificial Sequence: Synthetic polynucleotide

SEQ ID NO: 288 - protein, 330 aa, Artificial Sequence [sequence omitted]

SEQ ID NO: 289 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctgcaactacaacgagaagttcaagtcccggttcaccatctcccgggacaactccaagaacaccctgtacctccagatgaactccctgcgggccgaggacaccgccgtgtactactgtgccaaagaggacggctacgacgcttggtttgcctactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 290 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctgcaactacaacgagaagttcaagtcccggttcaccatctcccgggacaactccaagaacaccctgtacctccagatgaactccctgcgggccgaggacaccgccgtgtactactgtgccaaagaggacggctacgacgcttggtttgcctactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 291 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSICNYNEKFKSRFTISRDNSKNTLYLQMNSLRAEDTAVYYCAKEDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYNEKFKSRFTISRDNSKNTLYLQMNSLRAEDTAVYYCAKEDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - DNA, 57 bp, Artificial Sequence; identical to SEQ ID NO: 203
  Description of Artificial Sequence: Synthetic oligonucleotide

SEQ ID NO: 294 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctgcaactacaacgagaagttcaagtcccggttcaccatctcccgggacaactccaagaacaccctgtacctccagatgaactccctgcgggccgaggacaccgccgtgtactactgtgccaaagaggacggctacgacgcttggtttgcctactggggccagggcaccctggtcaccgtgtcatct

SEQ ID NO: 295 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYNEKFKSRFTISRDNSKNTLYLQMNSLRAEDTAVYYCAKEDGYDAWFAYWGQGTLVTVSS

SEQ ID NO: 296 - DNA, 987 bp, Artificial Sequence; identical to SEQ ID NO: 206
  Description of Artificial Sequence: Synthetic polynucleotide

SEQ ID NO: 297 - protein, 330 aa, Artificial Sequence [sequence omitted]

SEQ ID NO: 298 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacaacgagaagttcaagtcccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 299 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacaacgagaagttcaagtcccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 300 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVGDIYPGSSICNYNEKFKSRFTISVDNSKSTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 449 aa, Artificial Sequence
  Description of Artificial Sequence: Synthetic polypeptide
EVQLLESGGGLVQPGGSLRLSCAASGYTFTTYWITWVRQAPGKGLEWVGDIYPGSSICNYNEKFKSRFTISVDNSKSTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - DNA, 57 bp, Artificial Sequence; identical to SEQ ID NO: 203
  Description of Artificial Sequence: Synthetic oligonucleotide

SEQ ID NO: 303 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacaacgagaagttcaagtcccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatct

SEQ ID NO: 304 - protein, 119 aa, Artificial Sequence
  Description of Artificial Sequence: Synthetic polypeptide
EVQLLESGGGLVQPGGSLRLSCAASGYTFTTYWITWVRQAPGKGLEWVGDIYPGSSICNYNEKFKSRFTISVDNSKSTAYLQMNSLRAEDTAVYYCAREDGYDAWFAYWGQGTLVTVSS

SEQ ID NO: 305 - DNA, 987 bp, Artificial Sequence; identical to SEQ ID NO: 206
  Description of Artificial Sequence: Synthetic polynucleotide

SEQ ID NO: 306 - protein, 330 aa, Artificial Sequence [sequence omitted]

SEQ ID NO: 307 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacgccgactccgtcaagggccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 308 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacgccgactccgtcaagggccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 309 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVGDIYPGSSICNYADSVKGRFTISVDNSKSTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 310 - protein, 449 aa, Artificial Sequence
  Description of Artificial Sequence: Synthetic polypeptide
EVQLLESGGGLVQPGGSLRLSCAASGYTFTTYWITWVRQAPGKGLEWVGDIYPGSSICNYADSVKGRFTISVDNSKSTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - DNA, 57 bp, Artificial Sequence; identical to SEQ ID NO: 203
  Description of Artificial Sequence: Synthetic oligonucleotide

SEQ ID NO: 312 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacgccgactccgtcaagggccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatct

SEQ ID NO: 313 - protein, 119 aa, Artificial Sequence
  Description of Artificial Sequence: Synthetic polypeptide
EVQLLESGGGLVQPGGSLRLSCAASGYTFTTYWITWVRQAPGKGLEWVGDIYPGSSICNYADSVKGRFTISVDNSKSTAYLQMNSLRAEDTAVYYCAREDGYDAWFAYWGQGTLVTVSS

SEQ ID NO: 314 - DNA, 987 bp, Artificial Sequence; identical to SEQ ID NO: 206
  Description of Artificial Sequence: Synthetic polynucleotide

SEQ ID NO: 315 - protein, 330 aa, Artificial Sequence [sequence omitted]

SEQ ID NO: 316 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacgccgacaagttcaagggccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 317 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVGDIYPGSSICNYADKFKGRFTISVDNSKSTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 318 - protein, 449 aa, Artificial Sequence
  Description of Artificial Sequence: Synthetic polypeptide
EVQLLESGGGLVQPGGSLRLSCAASGYTFTTYWITWVRQAPGKGLEWVGDIYPGSSICNYADKFKGRFTISVDNSKSTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 319 - DNA, 57 bp, Artificial Sequence; identical to SEQ ID NO: 203
  Description of Artificial Sequence: Synthetic oligonucleotide

SEQ ID NO: 320 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacgccgacaagttcaagggccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatct

SEQ ID NO: 321 - protein, 119 aa, Artificial Sequence
  Description of Artificial Sequence: Synthetic polypeptide
EVQLLESGGGLVQPGGSLRLSCAASGYTFTTYWITWVRQAPGKGLEWVGDIYPGSSICNYADKFKGRFTISVDNSKSTAYLQMNSLRAEDTAVYYCAREDGYDAWFAYWGQGTLVTVSS

SEQ ID NO: 322 - DNA, 987 bp, Artificial Sequence; identical to SEQ ID NO: 206
  Description of Artificial Sequence: Synthetic polynucleotide

SEQ ID NO: 323 - protein, 330 aa, Artificial Sequence [sequence omitted]

SEQ ID NO: 324 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacaacgagaagttcaagtcccggttcaccatctccgtggacaactccaagaacaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 325 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacaacgagaagttcaagtcccggttcaccatctccgtggacaactccaagaacaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 326 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVGDIYPGSSICNYNEKFKSRFTISVDNSKNTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - protein, 449 aa, Artificial Sequence
  Description of Artificial Sequence: Synthetic polypeptide
EVQLLESGGGLVQPGGSLRLSCAASGYTFTTYWITWVRQAPGKGLEWVGDIYPGSSICNYNEKFKSRFTISVDNSKNTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 328 - DNA, 57 bp, Artificial Sequence; identical to SEQ ID NO: 203
  Description of Artificial Sequence: Synthetic oligonucleotide

SEQ ID NO: 329 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacaacgagaagttcaagtcccggttcaccatctccgtggacaactccaagaacaccgcctacctccagatgaactccctgagagccgaggacaccgccgtgtactactgcgccagagaggacggctacgacgcttggtttgcttactggggccagggcaccctggtcaccgtgtcatct

SEQ ID NO: 330 - protein, 119 aa, Artificial Sequence
  Description of Artificial Sequence: Synthetic polypeptide
EVQLLESGGGLVQPGGSLRLSCAASGYTFTTYWITWVRQAPGKGLEWVGDIYPGSSICNYNEKFKSRFTISVDNSKNTAYLQMNSLRAEDTAVYYCAREDGYDAWFAYWGQGTLVTVSS

SEQ ID NO: 331 - DNA, 1401 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacaacgagaagttcaagtcccggttcaccatctccgtggacaactccaagaacaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccggg

SEQ ID NO: 332 - protein, 330 aa, Artificial Sequence [sequence omitted]

SEQ ID NO: 333 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctccgtggacaactccaagaacaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 334 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctccgtggacaactccaagaacaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 335 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSICNYNEKFKSRFTISVDNSKNTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 336 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYNEKFKSRFTISVDNSKNTAYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 337 - DNA, 57 bp, Artificial Sequence; identical to SEQ ID NO: 203
  Description of Artificial Sequence: Synthetic oligonucleotide

SEQ ID NO: 338 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctccgtggacaactccaagaacaccgcctacctccagatgaactccctgagagccgaggacaccgccgtgtactactgcgccagagaggacggctacgacgcttggtttgcttactggggccagggcaccctggtcaccgtgtcatct

SEQ ID NO: 339 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYNEKFKSRFTISVDNSKNTAYLQMNSLRAEDTAVYYCAREDGYDAWFAYWGQGTLVTVSS

SEQ ID NO: 340 - DNA, 993 bp, Artificial Sequence
  Description of Artificial Sequence: Synthetic polynucleotide
gcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 341 - protein, 330 aa, Artificial Sequence [sequence omitted]

SEQ ID NO: 342 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctccgtggacaactccaagaacaccctgtacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 343 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctccgtggacaactccaagaacaccctgtacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 344 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSICNYNEKFKSRFTISVDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 345 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYNEKFKSRFTISVDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - DNA, 57 bp, Artificial Sequence; identical to SEQ ID NO: 203
  Description of Artificial Sequence: Synthetic oligonucleotide

SEQ ID NO: 347 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctccgtggacaactccaagaacaccctgtacctccagatgaactccctgagagccgaggacaccgccgtgtactactgcgccagagaggacggctacgacgcttggtttgcttactggggccagggcaccctggtcaccgtgtcatct

SEQ ID NO: 348 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYNEKFKSRFTISVDNSKNTLYLQMNSLRAEDTAVYYCAREDGYDAWFAYWGQGTLVTVSS

SEQ ID NO: 349 - DNA, 987 bp, Artificial Sequence; identical to SEQ ID NO: 206
  Description of Artificial Sequence: Synthetic polynucleotide

SEQ ID NO: 350 - protein, 330 aa, Artificial Sequence [sequence omitted]

SEQ ID NO: 351 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctcccgggacaactccaagaacaccctgtacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 352 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctcccgggacaactccaagaacaccctgtacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 353 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSICNYNEKFKSRFTISRDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 354 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYNEKFKSRFTISRDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 355 - DNA, 57 bp, Artificial Sequence; identical to SEQ ID NO: 203
  Description of Artificial Sequence: Synthetic oligonucleotide

SEQ ID NO: 356 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacaacgagaagttcaagtcccggttcaccatctcccgggacaactccaagaacaccctgtacctccagatgaactccctgagagccgaggacaccgccgtgtactactgcgccagagaggacggctacgacgcttggtttgcttactggggccagggcaccctggtcaccgtgtcatct

SEQ ID NO: 357 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYNEKFKSRFTISRDNSKNTLYLQMNSLRAEDTAVYYCAREDGYDAWFAYWGQGTLVTVSS

SEQ ID NO: 358 - DNA, 987 bp, Artificial Sequence; identical to SEQ ID NO: 206
  Description of Artificial Sequence: Synthetic polynucleotide

SEQ ID NO: 359 - protein, 330 aa, Artificial Sequence [sequence omitted]

SEQ ID NO: 360 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacgccgacaagttcaagggccggttcaccatctcccgggacaactccaagaacaccctgtacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 361 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacgccgacaagttcaagggccggttcaccatctcccgggacaactccaagaacaccctgtacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 362 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSICNYADKFKGRFTISRDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 363 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYADKFKGRFTISRDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 364 - DNA, 57 bp, Artificial Sequence; identical to SEQ ID NO: 203
  Description of Artificial Sequence: Synthetic oligonucleotide

SEQ ID NO: 365 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacgccgacaagttcaagggccggttcaccatctcccgggacaactccaagaacaccctgtacctccagatgaactccctgagagccgaggacaccgccgtgtactactgcgccagagaggacggctacgacgcttggtttgcttactggggccagggcaccctggtcaccgtgtcatct

SEQ ID NO: 366 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYADKFKGRFTISRDNSKNTLYLQMNSLRAEDTAVYYCAREDGYDAWFAYWGQGTLVTVSS

SEQ ID NO: 367 - DNA, 987 bp, Artificial Sequence; identical to SEQ ID NO: 206
  Description of Artificial Sequence: Synthetic polynucleotide

SEQ ID NO: 368 - protein, 330 aa, Artificial Sequence [sequence omitted]

SEQ ID NO: 369 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacgccgacaagttcaagggccggttcaccatctcccgggacaactccaagaacaccctgtacctccagatgaactccctgagagccgaggacaccgccgtgtactactgcgccaaagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 370 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacgccgacaagttcaagggccggttcaccatctcccgggacaactccaagaacaccctgtacctccagatgaactccctgagagccgaggacaccgccgtgtactactgcgccaaagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 371 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSICNYADKFKGRFTISRDNSKNTLYLQMNSLRAEDTAVYYCAKEDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 372 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYADKFKGRFTISRDNSKNTLYLQMNSLRAEDTAVYYCAKEDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 373 - DNA, 57 bp, Artificial Sequence; identical to SEQ ID NO: 203
  Description of Artificial Sequence: Synthetic oligonucleotide

SEQ ID NO: 374 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctgcaactacgccgacaagttcaagggccggttcaccatctcccgggacaactccaagaacaccctgtacctccagatgaactccctgagagccgaggacaccgccgtgtactactgcgccaaagaggacggctacgacgcttggtttgcttactggggccagggcaccctggtcaccgtgtcatct

SEQ ID NO: 375 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYADKFKGRFTISRDNSKNTLYLQMNSLRAEDTAVYYCAKEDGYDAWFAYWGQGTLVTVSS

SEQ ID NO: 376 - DNA, 987 bp, Artificial Sequence; identical to SEQ ID NO: 206
  Description of Artificial Sequence: Synthetic polynucleotide

SEQ ID NO: 377 - protein, 330 aa, Artificial Sequence [sequence omitted]

SEQ ID NO: 378 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctccaactacgccgactccgtcaagggccggttcaccatctcccgggacaactccaagaacaccctgtacctccagatgaactccctgcgggccgaggacaccgccgtgtactactgcgccagagaggacggctacgacgcttggtttgcctactggggccagggcaccctggtcaccgtgtcatctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 379 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctccaactacgccgactccgtcaagggccggttcaccatctcccgggacaactccaagaacaccctgtacctccagatgaactccctgcgggccgaggacaccgccgtgtactactgcgccagagaggacggctacgacgcttggtttgcctactggggccagggcaccctggtcaccgtgtcatctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 380 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSISNYADSVKGRFTISRDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 381 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSISNYADSVKGRFTISRDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 382 - DNA, 57 bp, Artificial Sequence; identical to SEQ ID NO: 203
  Description of Artificial Sequence: Synthetic oligonucleotide

SEQ ID NO: 383 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctccaactacgccgactccgtcaagggccggttcaccatctcccgggacaactccaagaacaccctgtacctccagatgaactccctgcgggccgaggacaccgccgtgtactactgcgccagagaggacggctacgacgcttggtttgcctactggggccagggcaccctggtcaccgtgtcatct

SEQ ID NO: 384 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSISNYADSVKGRFTISRDNSKNTLYLQMNSLRAEDTAVYYCAREDGYDAWFAYWGQGTLVTVSS

SEQ ID NO: 385 - DNA, 987 bp, Artificial Sequence
  Description of Artificial Sequence: Synthetic polynucleotide
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccggg

SEQ ID NO: 386 - protein, 330 aa, Artificial Sequence [sequence omitted]

SEQ ID NO: 387 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctccaactacaacgagaagttcaagtcccggttcaccatctcccgggacaactccaagaacaccctgtacctccagatgaactccctgcgggccgaggacaccgccgtgtactactgcgccagagaggacggctacgacgcttggtttgcctactggggccagggcaccctggtcaccgtgtcatctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 388 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctccaactacaacgagaagttcaagtcccggttcaccatctcccgggacaactccaagaacaccctgtacctccagatgaactccctgcgggccgaggacaccgccgtgtactactgcgccagagaggacggctacgacgcttggtttgcctactggggccagggcaccctggtcaccgtgtcatctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 389 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSISNYNEKFKSRFTISRDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 390 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSISNYNEKFKSRFTISRDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - DNA, 57 bp, Artificial Sequence; identical to SEQ ID NO: 203
  Description of Artificial Sequence: Synthetic oligonucleotide

SEQ ID NO: 392 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtgtccgacatctaccccggctcctccatctccaactacaacgagaagttcaagtcccggttcaccatctcccgggacaactccaagaacaccctgtacctccagatgaactccctgcgggccgaggacaccgccgtgtactactgcgccagagaggacggctacgacgcttggtttgcctactggggccagggcaccctggtcaccgtgtcatct

SEQ ID NO: 393 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSISNYNEKFKSRFTISRDNSKNTLYLQMNSLRAEDTAVYYCAREDGYDAWFAYWGQGTLVTVSS

SEQ ID NO: 394 - DNA, 993 bp, Artificial Sequence
  Description of Artificial Sequence: Synthetic polynucleotide
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 395 - protein, 330 aa, Artificial Sequence [sequence omitted]

SEQ ID NO: 396 - DNA, 1407 bp, Artificial Sequence
  Description of Artificial Sequence: Synthetic polynucleotide
atgggctggtcctgcatcatcctgtttctggtggccaccgccaccggcgtgcacagcgaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctccaactacaacgagaagttcaagtcccggttcaccatctccgtggacaactccaagaacaccctgtacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 397 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctccaactacaacgagaagttcaagtcccggttcaccatctccgtggacaactccaagaacaccctgtacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 398 - protein, 468 aa, Artificial Sequence
  Description of Artificial Sequence: Synthetic polypeptide
MGWSCIILFLVATATGVHSEVQLLESGGGLVQPGGSLRLSCAASGYTFTTYWITWVRQAPGKGLEWVSDIYPGSSISNYNEKFKSRFTISVDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - protein, 449 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSISNYNEKFKSRFTISVDNSKNTLYLQMNSLRAEDTAVYYCAREDGYDAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - DNA, 57 bp, Artificial Sequence; identical to SEQ ID NO: 203
  Description of Artificial Sequence: Synthetic oligonucleotide

SEQ ID NO: 401 - DNA, 357 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtctccgacatctaccccggctcctccatctccaactacaacgagaagttcaagtcccggttcaccatctccgtggacaactccaagaacaccctgtacctccagatgaactccctgagagccgaggacaccgccgtgtactactgcgccagagaggacggctacgacgcttggtttgcttactggggccagggcaccctggtcaccgtgtcatct

SEQ ID NO: 402 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSISNYNEKFKSRFTISVDNSKNTLYLQMNSLRAEDTAVYYCAREDGYDAWFAYWGQGTLVTVSS

SEQ ID NO: 403 - DNA, 993 bp, Artificial Sequence; identical to SEQ ID NO: 340
  Description of Artificial Sequence: Synthetic polynucleotide

SEQ ID NO: 404 - protein, 330 aa, Artificial Sequence [sequence omitted]

SEQ ID NO: 405 - DNA, 434 bp, Artificial Sequence
  Description of Artificial Sequence: Synthetic polynucleotide
atgaagttgcctgttaggctgttggtgatgatgttctggattcctgcttccagcagtgatgttttgatgacccaaactccactctccctgcctgtcagtcttggagatcaagcctccatctcttgcagatctagtcagagcattttacatagtaatggaaacacctatttagaatggtacctgcagaaaccaggccagtctccaaagctcctgatttgcaaagtttccaaccgattttctggggtcccagacaggttcagtggcagtggatcagggacagatttcacactcaagatcagcagagtggaggctgaggatctgggagtttattactgctttcaaggttcacatgttccattcacgttcggctcggggacaaagttggaaataaaacgggctgatgctgcaccaactgtatccatcttcccaccttc

SEQ ID NO: 406 - DNA, 377 bp, Artificial Sequence
  Description of Artificial Sequence: Synthetic polynucleotide
gatgttttgatgacccaaactccactctccctgcctgtcagtcttggagatcaagcctccatctcttgcagatctagtcagagcattttacatagtaatggaaacacctatttagaatggtacctgcagaaaccaggccagtctccaaagctcctgatttgcaaagtttccaaccgattttctggggtcccagacaggttcagtggcagtggatcagggacagatttcacactcaagatcagcagagtggaggctgaggatctgggagtttattactgctttcaaggttcacatgttccattcacgttcggctcggggacaaagttggaaataaaacgggctgatgctgcaccaactgtatccatcttcccaccttc

SEQ ID NO: 407 - protein, 145 aa, Artificial Sequence
  Description of Artificial Sequence: Synthetic polypeptide
MKLPVRLLVMMFWIPASSSDVLMTQTPLSLPVSLGDQASISCRSSQSILHSNGNTYLEWYLQKPGQSPKLLICKVSNRFSGVPDRFSGSGSGTDFTLKISRVEAEDLGVYYCFQGSHVPFTFGSGTKLEIKRADAAPTVSIFPPS

SEQ ID NO: 408 - protein, 126 aa, Artificial Sequence
  Description of Artificial Sequence: Synthetic polypeptide
DVLMTQTPLSLPVSLGDQASISCRSSQSILHSNGNTYLEWYLQKPGQSPKLLICKVSNRFSGVPDRFSGSGSGTDFTLKISRVEAEDLGVYYCFQGSHVPFTFGSGTKLEIKRADAAPTVSIFPPS

SEQ ID NO: 409 - DNA, 57 bp, Artificial Sequence
  Description of Artificial Sequence: Synthetic oligonucleotide
atgaagttgcctgttaggctgttggtgatgatgttctggattcctgcttccagcagt

SEQ ID NO: 410 - DNA, 336 bp, Artificial Sequence
  Description of Artificial Sequence: Synthetic polynucleotide
gatgttttgatgacccaaactccactctccctgcctgtcagtcttggagatcaagcctccatctcttgcagatctagtcagagcattttacatagtaatggaaacacctatttagaatggtacctgcagaaaccaggccagtctccaaagctcctgatttgcaaagtttccaaccgattttctggggtcccagacaggttcagtggcagtggatcagggacagatttcacactcaagatcagcagagtggaggctgaggatctgggagtttattactgctttcaaggttcacatgttccattcacgttcggctcggggacaaagttggaaataaaa

SEQ ID NO: 411 - protein, 112 aa, Artificial Sequence
  Description of Artificial Sequence: Synthetic polypeptide
DVLMTQTPLSLPVSLGDQASISCRSSQSILHSNGNTYLEWYLQKPGQSPKLLICKVSNRFSGVPDRFSGSGSGTDFTLKISRVEAEDLGVYYCFQGSHVPFTFGSGTKLEIK

SEQ ID NO: 412 - DNA, 41 bp, Artificial Sequence
  Description of Artificial Sequence: Synthetic oligonucleotide
cgggctgatgctgcaccaactgtatccatcttcccaccttc

SEQ ID NO: 413 - protein, 15 aa, Artificial Sequence
  Description of Artificial Sequence: Synthetic peptide
KRADAAPTVSIFPPS

SEQ ID NO: 414 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctcccagacggctgatctacaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 415 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctcccagacggctgatctacaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 416 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWFQQRPGQSPRRLIYKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 219 aa, Artificial Sequence
  Description of Artificial Sequence: Synthetic polypeptide
DVVMTQSPLSLPVTLGQPASISCRSSQSILHSNGNTYLEWFQQRPGQSPRRLIYKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - DNA, 57 bp, Artificial Sequence; identical to SEQ ID NO: 203
  Description of Artificial Sequence: Synthetic oligonucleotide

SEQ ID NO: 419 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctcccagacggctgatctacaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 420 - protein, 112 aa, Artificial Sequence
  Description of Artificial Sequence: Synthetic polypeptide
DVVMTQSPLSLPVTLGQPASISCRSSQSILHSNGNTYLEWFQQRPGQSPRRLIYKVSNRFSGVPDRFSGSGSGTDFTLKISRVEAEDVGVYYCFQGSHVPFTFGQGTKLEIK

SEQ ID NO: 421 - DNA, 321 bp, Artificial Sequence
  Description of Artificial Sequence: Synthetic polynucleotide
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 422 - protein, 107 aa, Artificial Sequence [sequence omitted]

SEQ ID NO: 423 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtctcccagactgctgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 424 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtctcccagactgctgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 425 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWYQQRPGQSPRLLICKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 426 - protein, 219 aa, Artificial Sequence
  Description of Artificial Sequence: Synthetic polypeptide
DVVMTQSPLSLPVTLGQPASISCRSSQSILHSNGNTYLEWYQQRPGQSPRLLICKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 427 - DNA, 57 bp, Artificial Sequence; identical to SEQ ID NO: 203
  Description of Artificial Sequence: Synthetic oligonucleotide

SEQ ID NO: 428 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtctcccagactgctgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 429 - protein, 112 aa, Artificial Sequence
  Description of Artificial Sequence: Synthetic polypeptide
DVVMTQSPLSLPVTLGQPASISCRSSQSILHSNGNTYLEWYQQRPGQSPRLLICKVSNRFSGVPDRFSGSGSGTDFTLKISRVEAEDVGVYYCFQGSHVPFTFGQGTKLEIK

SEQ ID NO: 430 - DNA, 321 bp, Artificial Sequence; identical to SEQ ID NO: 421
  Description of Artificial Sequence: Synthetic polynucleotide

SEQ ID NO: 431 - protein, 107 aa, Artificial Sequence [sequence omitted]

SEQ ID NO: 432 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctccccgtagactgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 433 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctccccgtagactgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 434 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWFQQRPGQSPRRLICKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 435 - protein, 219 aa, Artificial Sequence
  Description of Artificial Sequence: Synthetic polypeptide
DVVMTQSPLSLPVTLGQPASISCRSSQSILHSNGNTYLEWFQQRPGQSPRRLICKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 436 - DNA, 57 bp, Artificial Sequence; identical to SEQ ID NO: 203
  Description of Artificial Sequence: Synthetic oligonucleotide

SEQ ID NO: 437 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctccccgtagactgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 438 - protein, 112 aa, Artificial Sequence
  Description of Artificial Sequence: Synthetic polypeptide
DVVMTQSPLSLPVTLGQPASISCRSSQSILHSNGNTYLEWFQQRPGQSPRRLICKVSNRFSGVPDRFSGSGSGTDFTLKISRVEAEDVGVYYCFQGSHVPFTFGQGTKLEIK

SEQ ID NO: 439 - DNA, 321 bp, Artificial Sequence; identical to SEQ ID NO: 421
  Description of Artificial Sequence: Synthetic polynucleotide

SEQ ID NO: 440 - protein, 107 aa, Artificial Sequence [sequence omitted]

SEQ ID NO: 441 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtcccccagacggctgatctgcaaggtgtccaaccggttctctggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 442 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtcccccagacggctgatctgcaaggtgtccaaccggttctctggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 443 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWYQQRPGQSPRRLICKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 444 - protein, 219 aa, Artificial Sequence
  Description of Artificial Sequence: Synthetic polypeptide
DVVMTQSPLSLPVTLGQPASISCRSSQSILHSNGNTYLEWYQQRPGQSPRRLICKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 445 - DNA, 57 bp, Artificial Sequence; identical to SEQ ID NO: 203
  Description of Artificial Sequence: Synthetic oligonucleotide

SEQ ID NO: 446 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtcccccagacggctgatctgcaaggtgtccaaccggttctctggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 447 - protein, 112 aa, Artificial Sequence
  Description of Artificial Sequence: Synthetic polypeptide
DVVMTQSPLSLPVTLGQPASISCRSSQSILHSNGNTYLEWYQQRPGQSPRRLICKVSNRFSGVPDRFSGSGSGTDFTLKISRVEAEDVGVYYCFQGSHVPFTFGQGTKLEIK

SEQ ID NO: 448 - DNA, 321 bp, Artificial Sequence; identical to SEQ ID NO: 421
  Description of Artificial Sequence: Synthetic polynucleotide

SEQ ID NO: 449 - protein, 107 aa, Artificial Sequence [sequence omitted]

SEQ ID NO: 450 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggttccagcagcggcctggccagtcccccagactgctgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 451 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtcccccagactgctgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 452 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWFQQRPGQSPRLLICKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 453 - protein, 219 aa, Artificial Sequence
  Description of Artificial Sequence: Synthetic polypeptide
DVVMTQSPLSLPVTLGQPASISCRSSQSILHSNGNTYLEWFQQRPGQSPRLLICKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 454 - DNA, 57 bp, Artificial Sequence; identical to SEQ ID NO: 203
  Description of Artificial Sequence: Synthetic oligonucleotide

SEQ ID NO: 455 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtcccccagactgctgatctgcaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 456 - protein, 112 aa, Artificial Sequence
  Description of Artificial Sequence: Synthetic polypeptide
DVVMTQSPLSLPVTLGQPASISCRSSQSILHSNGNTYLEWFQQRPGQSPRLLICKVSNRFSGVPDRFSGSGSGTDFTLKISRVEAEDVGVYYCFQGSHVPFTFGQGTKLEIK

SEQ ID NO: 457 - DNA, 321 bp, Artificial Sequence; identical to SEQ ID NO: 421
  Description of Artificial Sequence: Synthetic polynucleotide

SEQ ID NO: 458 - protein, 107 aa, Artificial Sequence [sequence omitted]

SEQ ID NO: 459 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtctccccggctgctgatttccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 460 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtctccccggctgctgatttccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 461 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWYQQRPGQSPRLLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 462 - protein, 219 aa, Artificial Sequence
  Description of Artificial Sequence: Synthetic polypeptide
DVVMTQSPLSLPVTLGQPASISCRSSQSILHSNGNTYLEWYQQRPGQSPRLLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 463 - DNA, 57 bp, Artificial Sequence; identical to SEQ ID NO: 203
  Description of Artificial Sequence: Synthetic oligonucleotide

SEQ ID NO: 464 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtctccccggctgctgatttccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 465 - protein, 112 aa, Artificial Sequence
  Description of Artificial Sequence: Synthetic polypeptide
DVVMTQSPLSLPVTLGQPASISCRSSQSILHSNGNTYLEWYQQRPGQSPRLLISKVSNRFSGVPDRFSGSGSGTDFTLKISRVEAEDVGVYYCFQGSHVPFTFGQGTKLEIK

SEQ ID NO: 466 - DNA, 321 bp, Artificial Sequence; identical to SEQ ID NO: 421
  Description of Artificial Sequence: Synthetic polynucleotide

SEQ ID NO: 467 - protein, 107 aa, Artificial Sequence [sequence omitted]

SEQ ID NO: 468 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 469 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 470 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWFQQRPGQSPRRLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 471 - protein, 219 aa, Artificial Sequence
  Description of Artificial Sequence: Synthetic polypeptide
DVVMTQSPLSLPVTLGQPASISCRSSQSILHSNGNTYLEWFQQRPGQSPRRLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 472 - DNA, 57 bp, Artificial Sequence; identical to SEQ ID NO: 203
  Description of Artificial Sequence: Synthetic oligonucleotide

SEQ ID NO: 473 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 474 - protein, 112 aa, Artificial Sequence
  Description of Artificial Sequence: Synthetic polypeptide
DVVMTQSPLSLPVTLGQPASISCRSSQSILHSNGNTYLEWFQQRPGQSPRRLISKVSNRFSGVPDRFSGSGSGTDFTLKISRVEAEDVGVYYCFQGSHVPFTFGQGTKLEIK

SEQ ID NO: 475 - DNA, 321 bp, Artificial Sequence; identical to SEQ ID NO: 421
  Description of Artificial Sequence: Synthetic polynucleotide

SEQ ID NO: 476 - protein, 107 aa, Artificial Sequence [sequence omitted]

SEQ ID NO: 477 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcgtgcactccaacggcaacacctacctggaatggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 478 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcgtgcactccaacggcaacacctacctggaatggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 479 - protein, 238 aa, Artificial Sequence
  Description of Artificial Sequence: Synthetic polypeptide
MGWSCIILFLVATATGVHSDVVMTQSPLSLPVTLGQPASISCRSSQSIVHSNGNTYLEWFQQRPGQSPRRLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 480 - protein, 219 aa, Artificial Sequence
  Description of Artificial Sequence: Synthetic polypeptide
DVVMTQSPLSLPVTLGQPASISCRSSQSIVHSNGNTYLEWFQQRPGQSPRRLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 481 - DNA, 57 bp, Artificial Sequence; identical to SEQ ID NO: 203
  Description of Artificial Sequence: Synthetic oligonucleotide

SEQ ID NO: 482 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcgtgcactccaacggcaacacctacctggaatggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 483 - protein, 112 aa, Artificial Sequence
  Description of Artificial Sequence: Synthetic polypeptide
DVVMTQSPLSLPVTLGQPASISCRSSQSIVHSNGNTYLEWFQQRPGQSPRRLISKVSNRFSGVPDRFSGSGSGTDFTLKISRVEAEDVGVYYCFQGSHVPFTFGQGTKLEIK

SEQ ID NO: 484 - protein, 107 aa, Artificial Sequence [sequence omitted]

SEQ ID NO: 485 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcgtgcactccaacggcaacacctacctgaactggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 486 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcgtgcactccaacggcaacacctacctgaactggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 487 - protein, 238 aa, Artificial Sequence
  Description of Artificial Sequence: Synthetic polypeptide
MGWSCIILFLVATATGVHSDVVMTQSPLSLPVTLGQPASISCRSSQSIVHSNGNTYLNWFQQRPGQSPRRLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 488 - protein, 219 aa, Artificial Sequence
  Description of Artificial Sequence: Synthetic polypeptide
DVVMTQSPLSLPVTLGQPASISCRSSQSIVHSNGNTYLNWFQQRPGQSPRRLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 489 - DNA, 57 bp, Artificial Sequence; identical to SEQ ID NO: 203
  Description of Artificial Sequence: Synthetic oligonucleotide

SEQ ID NO: 490 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcgtgcactccaacggcaacacctacctgaactggttccagcagcggcctggccagtctcccagacggctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 491 - protein, 112 aa, Artificial Sequence
  Description of Artificial Sequence: Synthetic polypeptide
DVVMTQSPLSLPVTLGQPASISCRSSQSIVHSNGNTYLNWFQQRPGQSPRRLISKVSNRFSGVPDRFSGSGSGTDFTLKISRVEAEDVGVYYCFQGSHVPFTFGQGTKLEIK

SEQ ID NO: 492 - DNA, 321 bp, Artificial Sequence; identical to SEQ ID NO: 421
  Description of Artificial Sequence: Synthetic polynucleotide

SEQ ID NO: 493 - protein, 107 aa, Artificial Sequence [sequence omitted]

SEQ ID NO: 494 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcgtgcactccaacggcaacacctacctggaatggttccagcagcggcctggccagtctcccagacggctgatctacaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 495 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcgtgcactccaacggcaacacctacctggaatggttccagcagcggcctggccagtctcccagacggctgatctacaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 496 - protein, 238 aa, Artificial Sequence
  Description of Artificial Sequence: Synthetic polypeptide
MGWSCIILFLVATATGVHSDVVMTQSPLSLPVTLGQPASISCRSSQSIVHSNGNTYLEWFQQRPGQSPRRLIYKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 497 - protein, 219 aa, Artificial Sequence
  Description of Artificial Sequence: Synthetic polypeptide
DVVMTQSPLSLPVTLGQPASISCRSSQSIVHSNGNTYLEWFQQRPGQSPRRLIYKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 498 - DNA, 57 bp, Artificial Sequence; identical to SEQ ID NO: 203
  Description of Artificial Sequence: Synthetic oligonucleotide

SEQ ID NO: 499 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcgtgcactccaacggcaacacctacctggaatggttccagcagcggcctggccagtctcccagacggctgatctacaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 500 - protein, 112 aa, Artificial Sequence
  Description of Artificial Sequence: Synthetic polypeptide
DVVMTQSPLSLPVTLGQPASISCRSSQSIVHSNGNTYLEWFQQRPGQSPRRLIYKVSNRFSGVPDRFSGSGSGTDFTLKISRVEAEDVGVYYCFQGSHVPFTFGQGTKLEIK

SEQ ID NO: 501 - DNA, 321 bp, Artificial Sequence; identical to SEQ ID NO: 421
  Description of Artificial Sequence: Synthetic polynucleotide

SEQ ID NO: 502 - protein, 107 aa, Artificial Sequence [sequence omitted]

SEQ ID NO: 503 - DNA, 717 bp, Artificial Sequence
  Description of Artificial Sequence: Synthetic polynucleotide
atgggctggtcctgcatcatcctgtttctggtggccaccgccaccggcgtgcacagcgatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctacaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 504 - DNA, 660 bp, Artificial Sequence
  Description of Artificial Sequence: Synthetic polynucleotide
gatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctacaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 505 - protein, 238 aa, Artificial Sequence
  Description of Artificial Sequence: Synthetic polypeptide
MGWSCIILFLVATATGVHSDIQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 506 - protein, 219 aa, Artificial Sequence
  Description of Artificial Sequence: Synthetic polypeptide
DIQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 507 - DNA, 57 bp, Artificial Sequence; identical to SEQ ID NO: 203
  Description of Artificial Sequence: Synthetic oligonucleotide

SEQ ID NO: 508 - DNA, 336 bp, Artificial Sequence
  Description of Artificial Sequence: Synthetic polynucleotide
gatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctacaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaa

SEQ ID NO: 509 - protein, 112 aa, Artificial Sequence
  Description of Artificial Sequence: Synthetic polypeptide
DIQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIK

SEQ ID NO: 510 - DNA, 657 bp, Artificial Sequence
  Description of Artificial Sequence: Synthetic polynucleotide
gatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctacaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 511 - protein, 107 aa, Artificial Sequence [sequence omitted]

SEQ ID NO: 512 - DNA, 717 bp, Artificial Sequence
  Description of Artificial Sequence: Synthetic polynucleotide
atgggctggtcctgcatcatcctgtttctggtggccaccgccaccggcgtgcacagcgacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctgcaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 513 - DNA, 660 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctgcaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 514 - protein, 238 aa, Artificial Sequence
  Description of Artificial Sequence: Synthetic polypeptide
MGWSCIILFLVATATGVHSDVQMTQSPSSLSASVGDRVTITCRSSQSILHSNGNTYLEWYQQKPGKAPKLLICKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 515 - protein, 219 aa, Artificial Sequence
  Description of Artificial Sequence: Synthetic polypeptide
DVQMTQSPSSLSASVGDRVTITCRSSQSILHSNGNTYLEWYQQKPGKAPKLLICKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 516 - DNA, 57 bp, Artificial Sequence; identical to SEQ ID NO: 203
  Description of Artificial Sequence: Synthetic oligonucleotide

SEQ ID NO: 517 - DNA, 336 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctgcaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaa

SEQ ID NO: 518 - protein, 112 aa, Artificial Sequence
  Description of Artificial Sequence: Synthetic polypeptide
DVQMTQSPSSLSASVGDRVTITCRSSQSILHSNGNTYLEWYQQKPGKAPKLLICKVSNRFSGVPSRFSGSGSGTDFTLTISSLQPEDFATYYCFQGSHVPFTFGQGTKLEIK

SEQ ID NO: 519 - DNA, 321 bp, Artificial Sequence; identical to SEQ ID NO: 421
  Description of Artificial Sequence: Synthetic polynucleotide

SEQ ID NO: 520 - protein, 107 aa, Artificial Sequence [sequence omitted]

SEQ ID NO: 521 - DNA, 717 bp, Artificial Sequence
  Description of Artificial Sequence: Synthetic polynucleotide
atgggctggtcctgcatcatcctgtttctggtggccaccgccaccggcgtgcacagcgacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctacaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 522 - DNA, 660 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctacaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 523 - protein, 238 aa, Artificial Sequence
  Description of Artificial Sequence: Synthetic polypeptide
MGWSCIILFLVATATGVHSDVQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 524 - protein, 219 aa, Artificial Sequence
  Description of Artificial Sequence: Synthetic polypeptide
DVQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 525 - DNA, 57 bp, Artificial Sequence; identical to SEQ ID NO: 203
  Description of Artificial Sequence: Synthetic oligonucleotide

SEQ ID NO: 526 - DNA, 336 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctacaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaa

SEQ ID NO: 527 - protein, 112 aa, Artificial Sequence
  Description of Artificial Sequence: Synthetic polypeptide
DVQMTQSPSSLSASVGDRVTITCRSSQSILHSNGNTYLEWYQQKPGKAPKLLIYKVSNRFSGVPSRFSGSGSGTDFTLTISSLQPEDFATYYCFQGSHVPFTFGQGTKLEIK

SEQ ID NO: 528 - DNA, 321 bp, Artificial Sequence; identical to SEQ ID NO: 421
  Description of Artificial Sequence: Synthetic polynucleotide

SEQ ID NO: 529 - protein, 107 aa, Artificial Sequence [sequence omitted]

SEQ ID NO: 530 - DNA, 717 bp, Artificial Sequence
  Description of Artificial Sequence: Synthetic polynucleotide
atgggctggtcctgcatcatcctgtttctggtggccaccgccaccggcgtgcacagcgatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctgcaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 531 - DNA, 660 bp, Artificial Sequence
  Description of Artificial Sequence: Synthetic polynucleotide
gatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctgcaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 532 - protein, 238 aa, Artificial Sequence
  Description of Artificial Sequence: Synthetic polypeptide
MGWSCIILFLVATATGVHSDIQMTQSPSSLSASVGDRVTITCRSSQSILHSNGNTYLEWYQQKPGKAPKLLICKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 533 - protein, 219 aa, Artificial Sequence
  Description of Artificial Sequence: Synthetic polypeptide
DIQMTQSPSSLSASVGDRVTITCRSSQSILHSNGNTYLEWYQQKPGKAPKLLICKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 534 - DNA, 57 bp, Artificial Sequence; identical to SEQ ID NO: 203
  Description of Artificial Sequence: Synthetic oligonucleotide

SEQ ID NO: 535 - DNA, 336 bp, Artificial Sequence
  Description of Artificial Sequence: Synthetic polynucleotide
gatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctgcaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaa

SEQ ID NO: 536 - protein, 112 aa, Artificial Sequence
  Description of Artificial Sequence: Synthetic polypeptide
DIQMTQSPSSLSASVGDRVTITCRSSQSILHSNGNTYLEWYQQKPGKAPKLLICKVSNRFSGVPSRFSGSGSGTDFTLTISSLQPEDFATYYCFQGSHVPFTFGQGTKLEIK

SEQ ID NO: 537 - DNA, 324 bp, Artificial Sequence
  Description of Artificial Sequence: Synthetic polynucleotide
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 538 - protein, 107 aa, Artificial Sequence [sequence omitted]

SEQ ID NO: 539 - DNA, 717 bp, Artificial Sequence
  Description of Artificial Sequence: Synthetic polynucleotide
atgggctggtcctgcatcatcctgtttctggtggccaccgccaccggcgtgcacagcgacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 540 - DNA, 568 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcag

SEQ ID NO: 541 - protein, 238 aa, Artificial Sequence
  Description of Artificial Sequence: Synthetic polypeptide
MGWSCIILFLVATATGVHSDVQMTQSPSSLSASVGDRVTITCRSSQSILHSNGNTYLEWYQQKPGKAPKLLISKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 219 aa, Artificial Sequence
  Description of Artificial Sequence: Synthetic polypeptide
DVQMTQSPSSLSASVGDRVTITCRSSQSILHSNGNTYLEWYQQKPGKAPKLLISKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 543 - DNA, 57 bp, Artificial Sequence; identical to SEQ ID NO: 203
  Description of Artificial Sequence: Synthetic oligonucleotide

SEQ ID NO: 544 - DNA, 336 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcctgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaa

SEQ ID NO: 545 - protein, 112 aa, Artificial Sequence
  Description of Artificial Sequence: Synthetic polypeptide
DVQMTQSPSSLSASVGDRVTITCRSSQSILHSNGNTYLEWYQQKPGKAPKLLISKVSNRFSGVPSRFSGSGSGTDFTLTISSLQPEDFATYYCFQGSHVPFTFGQGTKLEIK

SEQ ID NO: 546 - DNA, 321 bp, Artificial Sequence; identical to SEQ ID NO: 421
  Description of Artificial Sequence: Synthetic polynucleotide

SEQ ID NO: 547 - protein, 107 aa, Artificial Sequence [sequence omitted]

SEQ ID NO: 548 - DNA, 717 bp, Artificial Sequence
  Description of Artificial Sequence: Synthetic polynucleotide
atgggctggtcctgcatcatcctgtttctggtggccaccgccaccggcgtgcacagcgacgtgcagatgacccagtccccttccagcctgtctgcctccgtgggcgacagagtgaccatcacctgtcggtcctcccagtccatcgtgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 549 - DNA, 660 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcgtgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 550 - protein, 238 aa, Artificial Sequence
  Description of Artificial Sequence: Synthetic polypeptide
MGWSCIILFLVATATGVHSDVQMTQSPSSLSASVGDRVTITCRSSQSIVHSNGNTYLEWYQQKPGKAPKLLISKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 551 - protein, 219 aa, Artificial Sequence
  Description of Artificial Sequence: Synthetic polypeptide
DVQMTQSPSSLSASVGDRVTITCRSSQSIVHSNGNTYLEWYQQKPGKAPKLLISKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 552 - DNA, 57 bp, Artificial Sequence; identical to SEQ ID NO: 203
  Description of Artificial Sequence: Synthetic oligonucleotide

SEQ ID NO: 553 - DNA, 336 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcgtgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaa

SEQ ID NO: 554 - protein, 112 aa, Artificial Sequence
  Description of Artificial Sequence: Synthetic polypeptide
DVQMTQSPSSLSASVGDRVTITCRSSQSIVHSNGNTYLEWYQQKPGKAPKLLISKVSNRFSGVPSRFSGSGSGTDFTLTISSLQPEDFATYYCFQGSHVPFTFGQGTKLEIK

SEQ ID NO: 555 - DNA, 321 bp, Artificial Sequence; identical to SEQ ID NO: 421
  Description of Artificial Sequence: Synthetic polynucleotide

SEQ ID NO: 556 - protein, 107 aa, Artificial Sequence [sequence omitted]

SEQ ID NO: 557 - DNA, 717 bp, Artificial Sequence
  Description of Artificial Sequence: Synthetic polynucleotide
atgggctggtcctgcatcatcctgtttctggtggccaccgccaccggcgtgcacagcgacgtgcagatgacccagtccccttccagcctgtctgcctccgtgggcgacagagtgaccatcacctgtcggtcctcccagtccatcgtgcactccaacggcaacacctacctgaactggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 558 - DNA, 660 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcgtgcactccaacggcaacacctacctgaactggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 559 - protein, 238 aa, Artificial Sequence
  Description of Artificial Sequence: Synthetic polypeptide
MGWSCIILFLVATATGVHSDVQMTQSPSSLSASVGDRVTITCRSSQSIVHSNGNTYLNWYQQKPGKAPKLLISKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 560 - protein, 219 aa, Artificial Sequence
  Description of Artificial Sequence: Synthetic polypeptide
DVQMTQSPSSLSASVGDRVTITCRSSQSIVHSNGNTYLNWYQQKPGKAPKLLISKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 561 - DNA, 57 bp, Artificial Sequence; identical to SEQ ID NO: 203
  Description of Artificial Sequence: Synthetic oligonucleotide

SEQ ID NO: 562 - DNA, 336 bp, Artificial Sequence
  Description of Artificial Sequence: Synthetic polynucleotide
gacgtgcagatgacccagtccccttccagcctgtctgcctccgtgggcgacagagtgaccatcacctgtcggtcctcccagtccatcgtgcactccaacggcaacacctacctgaactggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaa

SEQ ID NO: 563 - protein, 112 aa, Artificial Sequence
  Description of Artificial Sequence: Synthetic polypeptide
DVQMTQSPSSLSASVGDRVTITCRSSQSIVHSNGNTYLNWYQQKPGKAPKLLISKVSNRFSGVPSRFSGSGSGTDFTLTISSLQPEDFATYYCFQGSHVPFTFGQGTKLEIK

SEQ ID NO: 564 - DNA, 324 bp, Artificial Sequence; identical to SEQ ID NO: 537
  Description of Artificial Sequence: Synthetic polynucleotide

SEQ ID NO: 565 - protein, 107 aa, Artificial Sequence [sequence omitted]

SEQ ID NO: 566 - DNA, 717 bp, Artificial Sequence
  Description of Artificial Sequence: Synthetic polynucleotide
atgggctggtcctgcatcatcctgtttctggtggccaccgccaccggcgtgcacagcgatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 567 - DNA, 660 bp, Artificial Sequence
  Description of Artificial Sequence: Synthetic polynucleotide
gatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 568 - protein, 238 aa, Artificial Sequence
  Description of Artificial Sequence: Synthetic polypeptide
MGWSCIILFLVATATGVHSDIQMTQSPSSLSASVGDRVTITCRSSQSILHSNGNTYLEWYQQKPGKAPKLLISKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 569 - protein, 219 aa, Artificial Sequence
  Description of Artificial Sequence: Synthetic polypeptide
DIQMTQSPSSLSASVGDRVTITCRSSQSILHSNGNTYLEWYQQKPGKAPKLLISKVSNRFSGVPSRFSGSGSGTDFTLTISSLQPEDFATYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 570 - DNA, 57 bp, Artificial Sequence; identical to SEQ ID NO: 203
  Description of Artificial Sequence: Synthetic oligonucleotide

SEQ ID NO: 571 - DNA, 336 bp, Artificial Sequence
  Description of Artificial Sequence: Synthetic polynucleotide
gatatccagatgacccagtccccttccagcctgtccgcctctgtgggcgacagagtgaccatcacctgtcggtcctcccagtccatcctgcactccaacggcaacacctacctggaatggtatcagcagaagcccggcaaggcccctaagctgctgatctccaaggtgtccaaccggttctccggcgtgccctccagattctccggctctggctctggcaccgacttcaccctgaccatctccagcctccagcccgaggacttcgccacctactactgttttcaaggctcccacgtgcccttcaccttcggccagggcaccaagctggaaatcaaa

SEQ ID NO: 572 - protein, 112 aa, Artificial Sequence
  Description of Artificial Sequence: Synthetic polypeptide
DIQMTQSPSSLSASVGDRVTITCRSSQSILHSNGNTYLEWYQQKPGKAPKLLISKVSNRFSGVPSRFSGSGSGTDFTLTISSLQPEDFATYYCFQGSHVPFTFGQGTKLEIK

SEQ ID NO: 573 - DNA, 324 bp, Artificial Sequence; identical to SEQ ID NO: 537
  Description of Artificial Sequence: Synthetic polynucleotide

SEQ ID NO: 574 - protein, 107 aa, Artificial Sequence [sequence omitted]

SEQ ID NO: 575 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggttccagcagcggcctggccagtcccccagactgctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 576 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtcccccagactgctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 577 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWFQQRPGQSPRLLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 578 - protein, 219 aa, Artificial Sequence
  Description of Artificial Sequence: Synthetic polypeptide
DVVMTQSPLSLPVTLGQPASISCRSSQSILHSNGNTYLEWFQQRPGQSPRLLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 579 - DNA, 57 bp, Artificial Sequence; identical to SEQ ID NO: 203
  Description of Artificial Sequence: Synthetic oligonucleotide

SEQ ID NO: 580 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggttccagcagcggcctggccagtcccccagactgctgatctccaaggtgtccaaccggttctccggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 581 - protein, 112 aa, Artificial Sequence
  Description of Artificial Sequence: Synthetic polypeptide
DVVMTQSPLSLPVTLGQPASISCRSSQSILHSNGNTYLEWFQQRPGQSPRLLISKVSNRFSGVPDRFSGSGSGTDFTLKISRVEAEDVGVYYCFQGSHVPFTFGQGTKLEIK

SEQ ID NO: 582 - DNA, 321 bp, Artificial Sequence; identical to SEQ ID NO: 421
  Description of Artificial Sequence: Synthetic polynucleotide

SEQ ID NO: 583 - protein, 107 aa, Artificial Sequence [sequence omitted]

SEQ ID NO: 584 - DNA, 717 bp, Artificial Sequence
  Description of Artificial Sequence: Synthetic polynucleotide
atgggctggtcctgcatcatcctgtttctggtggccaccgccaccggcgtgcacagcgacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtcccccagacggctgatctccaaggtgtccaaccggttctctggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 585 - DNA, 660 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtcccccagacggctgatctccaaggtgtccaaccggttctctggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 586 - protein, 238 aa, Artificial Sequence
  Description of Artificial Sequence: Synthetic polypeptide
MGWSCIILFLVATATGVHSDVVMTQSPLSLPVTLGQPASISCRSSQSILHSNGNTYLEWYQQRPGQSPRRLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 587 - protein, 219 aa, Artificial Sequence
  Description of Artificial Sequence: Synthetic polypeptide
DVVMTQSPLSLPVTLGQPASISCRSSQSILHSNGNTYLEWYQQRPGQSPRRLISKVSNRFSGVPDRFSGSGSGTDFTLKISRVEAEDVGVYYCFQGSHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 588 - DNA, 57 bp, Artificial Sequence; identical to SEQ ID NO: 203
  Description of Artificial Sequence: Synthetic oligonucleotide

SEQ ID NO: 589 - DNA, 336 bp, Artificial Sequence
  Description of Artificial Sequence: Synthetic polynucleotide
gacgtcgtgatgacacagtcccccctgtccctgcctgtgaccctgggacagcctgcctccatctcctgcagatcctcccagtccatcctgcactccaacggcaacacctacctggaatggtatcagcagcggcctggccagtcccccagacggctgatctccaaggtgtccaaccggttctctggcgtgcccgacagattctccggctctggctctggcaccgacttcaccctgaagatctcccgggtggaagccgaggacgtgggcgtgtactactgttttcaaggctcccacgtgcccttcaccttcggccagggcaccaagctggaaatcaaa

SEQ ID NO: 590 - protein, 112 aa, Artificial Sequence
  Description of Artificial Sequence: Synthetic polypeptide
DVVMTQSPLSLPVTLGQPASISCRSSQSILHSNGNTYLEWYQQRPGQSPRRLISKVSNRFSGVPDRFSGSGSGTDFTLKISRVEAEDVGVYYCFQGSHVPFTFGQGTKLEIK

SEQ ID NO: 591 - DNA, 321 bp, Artificial Sequence; identical to SEQ ID NO: 421
  Description of Artificial Sequence: Synthetic polynucleotide

SEQ ID NO: 592 - protein, 107 aa, Artificial Sequence [sequence omitted]

SEQ ID NO: 593 - DNA, 15 bp, Artificial Sequence
  Description of Artificial Sequence: Synthetic oligonucleotide
acctactggataacc

SEQ ID NO: 594 - protein, 5 aa, Artificial Sequence
  Description of Artificial Sequence: Synthetic peptide
TYWIT

SEQ ID NO: 595 - DNA, 51 bp, Artificial Sequence
  Description of Artificial Sequence: Synthetic oligonucleotide
gatatttatcctggtagtagtatttgtaactacaatgagaagttcaagagc

SEQ ID NO: 596 - protein, 17 aa, Artificial Sequence
  Description of Artificial Sequence: Synthetic peptide
DIYPGSSICNYNEKFKS

SEQ ID NO: 597 - DNA, 30 bp, Artificial Sequence
  Description of Artificial Sequence: Synthetic oligonucleotide
gaggatggttacgacgcctggtttgcttac

SEQ ID NO: 598 - protein, 10 aa, Artificial Sequence
  Description of Artificial Sequence: Synthetic peptide
EDGYDAWFAY

SEQ ID NO: 599 - DNA, 15 bp, Artificial Sequence
  Description of Artificial Sequence: Synthetic oligonucleotide
acctactggatcacc

SEQ ID NO: 600 - protein, 5 aa, Artificial Sequence
  Description of Artificial Sequence: Synthetic peptide
TYWIT

SEQ ID NO: 601 - DNA, 51 bp, Artificial Sequence
  Description of Artificial Sequence: Synthetic oligonucleotide
gacatctaccccggctcctccatctgcaactacaacgagaagttcaagtcc

SEQ ID NO: 602 - protein, 17 aa, Artificial Sequence
  Description of Artificial Sequence: Synthetic peptide
DIYPGSSICNYNEKFKS

SEQ ID NO: 603 - DNA, 30 bp, Artificial Sequence
  Description of Artificial Sequence: Synthetic oligonucleotide
gaggacggctacgacgcttggtttgcctac

SEQ ID NO: 604 - protein, 10 aa, Artificial Sequence
  Description of Artificial Sequence: Synthetic peptide
EDGYDAWFAY

SEQ ID NO: 605 - DNA, 15 bp, Artificial Sequence
  Description of Artificial Sequence: Synthetic oligonucleotide
acctactggatcacc

SEQ ID NO: 606 - protein, 5 aa, Artificial Sequence
  Description of Artificial Sequence: Synthetic peptide
TYWIT

SEQ ID NO: 607 - DNA, 51 bp, Artificial Sequence; identical to SEQ ID NO: 601
  Description of Artificial Sequence: Synthetic oligonucleotide

SEQ ID NO: 608 - protein, 17 aa, Artificial Sequence
  Description of Artificial Sequence: Synthetic peptide
DIYPGSSICNYNEKFKS

SEQ ID NO: 609 - DNA, 30 bp, Artificial Sequence; identical to SEQ ID NO: 603
  Description of Artificial Sequence: Synthetic oligonucleotide

SEQ ID NO: 610 - protein, 10 aa, Artificial Sequence
  Description of Artificial Sequence: Synthetic peptide
EDGYDAWFAY

SEQ ID NO: 611 - DNA, 15 bp, Artificial Sequence
  Description of Artificial Sequence: Synthetic oligonucleotide
acctactggatcacc

SEQ ID NO: 612 - protein, 5 aa, Artificial Sequence
  Description of Artificial Sequence: Synthetic peptide
TYWIT

SEQ ID NO: 613 - DNA, 51 bp, Artificial Sequence; identical to SEQ ID NO: 601
  Description of Artificial Sequence: Synthetic oligonucleotide

SEQ ID NO: 614 - protein, 17 aa, Artificial Sequence
  Description of Artificial Sequence: Synthetic peptide
DIYPGSSICNYNEKFKS

SEQ ID NO: 615 - DNA, 30 bp, Artificial Sequence; identical to SEQ ID NO: 603
  Description of Artificial Sequence: Synthetic oligonucleotide

SEQ ID NO: 616 - protein, 10 aa, Artificial Sequence
  Description of Artificial Sequence: Synthetic peptide
EDGYDAWFAY

SEQ ID NO: 617 - DNA, 15 bp, Artificial Sequence
  Description of Artificial Sequence: Synthetic oligonucleotide
acctactggatcacc

SEQ ID NO: 618 - protein, 5 aa, Artificial Sequence
  Description of Artificial Sequence: Synthetic peptide
TYWIT

SEQ ID NO: 619 - DNA, 51 bp, Artificial Sequence
  Description of Artificial Sequence: Synthetic oligonucleotide
gacatctaccccggctcctccatctgcaactacgcccagaaattccagggc

SEQ ID NO: 620 - protein, 17 aa, Artificial Sequence
  Description of Artificial Sequence: Synthetic peptide
DIYPGSSICNYAQKFQG

SEQ ID NO: 621 - DNA, 30 bp, Artificial Sequence; identical to SEQ ID NO: 603
  Description of Artificial Sequence: Synthetic oligonucleotide

SEQ ID NO: 622 - protein, 10 aa, Artificial Sequence
  Description of Artificial Sequence: Synthetic peptide
EDGYDAWFAY

SEQ ID NO: 623 - DNA, 15 bp, Artificial Sequence
  Description of Artificial Sequence: Synthetic oligonucleotide
acctactggatcacc

SEQ ID NO: 624 - protein, 5 aa, Artificial Sequence
  Description of Artificial Sequence: Synthetic peptide
TYWIT

SEQ ID NO: 625 - DNA, 51 bp, Artificial Sequence
  Description of Artificial Sequence: Synthetic oligonucleotide
gacatctaccccggctcctccatctccaactacaacgagaagttcaagtcc

SEQ ID NO: 626 - protein, 17 aa, Artificial Sequence
  Description of Artificial Sequence: Synthetic peptide
DIYPGSSISNYNEKFKS

SEQ ID NO: 627 - DNA, 30 bp, Artificial Sequence; identical to SEQ ID NO: 603
  Description of Artificial Sequence: Synthetic oligonucleotide

SEQ ID NO: 628 - protein, 10 aa, Artificial Sequence
  Description of Artificial Sequence: Synthetic peptide
EDGYDAWFAY

SEQ ID NO: 629 - DNA, 15 bp, Artificial Sequence
  Description of Artificial Sequence: Synthetic oligonucleotide
acctactggatcacc

SEQ ID NO: 630 - protein, 5 aa, Artificial Sequence
  Description of Artificial Sequence: Synthetic peptide
TYWIT

SEQ ID NO: 631 - DNA, 51 bp, Artificial Sequence; identical to SEQ ID NO: 625
  Description of Artificial Sequence: Synthetic oligonucleotide

SEQ ID NO: 632 - protein, 17 aa, Artificial Sequence
  Description of Artificial Sequence: Synthetic peptide
DIYPGSSISNYNEKFKS

SEQ ID NO: 633 - DNA, 30 bp, Artificial Sequence; identical to SEQ ID NO: 603
  Description of Artificial Sequence: Synthetic oligonucleotide

SEQ ID NO: 634 - protein, 10 aa, Artificial Sequence
  Description of Artificial Sequence: Synthetic peptide
EDGYDAWFAY

SEQ ID NO: 635 - DNA, 15 bp, Artificial Sequence
  Description of Artificial Sequence: Synthetic oligonucleotide
acctactggatcacc

SEQ ID NO: 636 - protein, 5 aa, Artificial Sequence
  Description of Artificial Sequence: Synthetic peptide
TYWIT

SEQ ID NO: 637 - DNA, 51 bp, Artificial Sequence
  Description of Artificial Sequence: Synthetic oligonucleotide
gacatctaccccggctcctccatctccaactacgcccagaagttccagggc

SEQ ID NO: 638 - protein, 17 aa, Artificial Sequence
  Description of Artificial Sequence: Synthetic peptide
DIYPGSSISNYAQKFQG

SEQ ID NO: 639 - DNA, 30 bp, Artificial Sequence; identical to SEQ ID NO: 603
  Description of Artificial Sequence: Synthetic oligonucleotide

SEQ ID NO: 640 - protein, 10 aa, Artificial Sequence
  Description of Artificial Sequence: Synthetic peptide
EDGYDAWFAY

SEQ ID NO: 641 - DNA, 15 bp, Artificial Sequence
  Description of Artificial Sequence: Synthetic oligonucleotide
acctactggatcacc

SEQ ID NO: 642 - protein, 5 aa, Artificial Sequence
  Description of Artificial Sequence: Synthetic peptide
TYWIT

SEQ ID NO: 643 - DNA, 51 bp, Artificial Sequence; identical to SEQ ID NO: 637
  Description of Artificial Sequence: Synthetic oligonucleotide

SEQ ID NO: 644 - protein, 17 aa, Artificial Sequence
  Description of Artificial Sequence: Synthetic peptide
DIYPGSSISNYAQKFQG

SEQ ID NO: 645 - DNA, 30 bp, Artificial Sequence; identical to SEQ ID NO: 603
  Description of Artificial Sequence: Synthetic oligonucleotide

SEQ ID NO: 646 - protein, 10 aa, Artificial Sequence
  Description of Artificial Sequence: Synthetic peptide
EDGYDAWFAY

SEQ ID NO: 647 - DNA, 15 bp, Artificial Sequence
  Description of Artificial Sequence: Synthetic oligonucleotide
acctactggatcacc

SEQ ID NO: 648 - protein, 5 aa, Artificial Sequence
  Description of Artificial Sequence: Synthetic peptide
TYWIT

SEQ ID NO: 649 - DNA, 51 bp, Artificial Sequence
  Description of Artificial Sequence: Synthetic oligonucleotide
gacatctaccccggctcctccatctgcaactacgcccagaagttccagggc

SEQ ID NO: 650 - protein, 17 aa, Artificial Sequence
  Description of Artificial Sequence: Synthetic peptide
DIYPGSSICNYAQKFQG

SEQ ID NO: 651 - DNA, 30 bp, Artificial Sequence; identical to SEQ ID NO: 603
  Description of Artificial Sequence: Synthetic oligonucleotide

SEQ ID NO: 652 - protein, 10 aa, Artificial Sequence
  Description of Artificial Sequence: Synthetic peptide
EDGYDAWFAY

SEQ ID NO: 653 - DNA, 15 bp, Artificial Sequence
  Description of Artificial Sequence: Synthetic oligonucleotide
acctactggatcacc

SEQ ID NO: 654 - protein, 5 aa, Artificial Sequence
  Description of Artificial Sequence: Synthetic peptide
TYWIT

SEQ ID NO: 655 - DNA, 51 bp, Artificial Sequence; identical to SEQ ID NO: 649
  Description of Artificial Sequence: Synthetic oligonucleotide

SEQ ID NO: 656 - protein, 17 aa, Artificial Sequence
  Description of Artificial Sequence: Synthetic peptide
DIYPGSSICNYAQKFQG

SEQ ID NO: 657 - DNA, 30 bp, Artificial Sequence; identical to SEQ ID NO: 603
  Description of Artificial Sequence: Synthetic oligonucleotide

SEQ ID NO: 658 - protein, 10 aa, Artificial Sequence
  Description of Artificial Sequence: Synthetic peptide
EDGYDAWFAY

SEQ ID NO: 659 - DNA, 15 bp, Artificial Sequence
  Description of Artificial Sequence: Synthetic oligonucleotide
acctactggatcacc

SEQ ID NO: 660 - protein, 5 aa, Artificial Sequence
  Description of Artificial Sequence: Synthetic peptide
TYWIT

SEQ ID NO: 661 - DNA, 51 bp, Artificial Sequence; identical to SEQ ID NO: 601
  Description of Artificial Sequence: Synthetic oligonucleotide

SEQ ID NO: 662 - protein, 17 aa, Artificial Sequence
  Description of Artificial Sequence: Synthetic peptide
DIYPGSSICNYNEKFKS

SEQ ID NO: 663 - DNA, 30 bp, Artificial Sequence; identical to SEQ ID NO: 603
  Description of Artificial Sequence: Synthetic oligonucleotide

SEQ ID NO: 664 - protein, 10 aa, Artificial Sequence
  Description of Artificial Sequence: Synthetic peptide
EDGYDAWFAY

SEQ ID NO: 665 - DNA, 15 bp, Artificial Sequence
  Description of Artificial Sequence: Synthetic oligonucleotide
acctactggatcacc

SEQ ID NO: 666 - protein, 5 aa, Artificial Sequence
  Description of Artificial Sequence: Synthetic peptide
TYWIT

SEQ ID NO: 667 - DNA, 51 bp, Artificial Sequence; identical to SEQ ID NO: 601
  Description of Artificial Sequence: Synthetic oligonucleotide

SEQ ID NO: 668 - protein, 17 aa, Artificial Sequence
  Description of Artificial Sequence: Synthetic peptide
DIYPGSSICNYNEKFKS

SEQ ID NO: 669 - DNA, 30 bp, Artificial Sequence
  Description of Artificial Sequence: Synthetic oligonucleotide
gaggacggctacgacgcttggtttgcttac

SEQ ID NO: 670 - protein, 10 aa, Artificial Sequence
  Description of Artificial Sequence: Synthetic peptide
EDGYDAWFAY

SEQ ID NO: 671 - DNA, 15 bp, Artificial Sequence
  Description of Artificial Sequence: Synthetic oligonucleotide
acctactggatcacc

SEQ ID NO: 672 - protein, 5 aa, Artificial Sequence
  Description of Artificial Sequence: Synthetic peptide
TYWIT

SEQ ID NO: 673 - DNA, 51 bp, Artificial Sequence
  Description of Artificial Sequence: Synthetic oligonucleotide
gacatctaccccggctcctccatctgcaactacgccgactccgtcaagggc

SEQ ID NO: 674 - protein, 17 aa, Artificial Sequence
  Description of Artificial Sequence: Synthetic peptide
DIYPGSSICNYADSVKG

SEQ ID NO: 675 - DNA, 30 bp, Artificial Sequence; identical to SEQ ID NO: 669
  Description of Artificial Sequence: Synthetic oligonucleotide

SEQ ID NO: 676 - protein, 10 aa, Artificial Sequence
  Description of Artificial Sequence: Synthetic peptide
EDGYDAWFAY

SEQ ID NO: 677 - DNA, 15 bp, Artificial Sequence
  Description of Artificial Sequence: Synthetic oligonucleotide
acctactggatcacc

SEQ ID NO: 678 - protein, 5 aa, Artificial Sequence
  Description of Artificial Sequence: Synthetic peptide
TYWIT

SEQ ID NO: 679 - DNA, 51 bp, Artificial Sequence
  Description of Artificial Sequence: Synthetic oligonucleotide
gacatctaccccggctcctccatctgcaactacgccgacaagttcaagggc

SEQ ID NO: 680 - protein, 17 aa, Artificial Sequence
  Description of Artificial Sequence: Synthetic peptide
DIYPGSSICNYADKFKG

SEQ ID NO: 681 - DNA, 30 bp, Artificial Sequence; identical to SEQ ID NO: 669
  Description of Artificial Sequence: Synthetic oligonucleotide

SEQ ID NO: 682 - protein, 10 aa, Artificial Sequence
  Description of Artificial Sequence: Synthetic peptide
EDGYDAWFAY

SEQ ID NO: 683 - DNA, 15 bp, Artificial Sequence
  Description of Artificial Sequence: Synthetic oligonucleotide
acctactggatcacc

SEQ ID NO: 684 - protein, 5 aa, Artificial Sequence
  Description of Artificial Sequence: Synthetic peptide
TYWIT

SEQ ID NO: 685 - DNA, 51 bp, Artificial Sequence; identical to SEQ ID NO: 601
  Description of Artificial Sequence: Synthetic oligonucleotide

SEQ ID NO: 686 - protein, 17 aa, Artificial Sequence
  Description of Artificial Sequence: Synthetic peptide
DIYPGSSICNYNEKFKS

SEQ ID NO: 687 - DNA, 30 bp, Artificial Sequence; identical to SEQ ID NO: 669
  Description of Artificial Sequence: Synthetic oligonucleotide

SEQ ID NO: 688 - protein, 10 aa, Artificial Sequence
  Description of Artificial Sequence: Synthetic peptide
EDGYDAWFAY

SEQ ID NO: 689 - DNA, 15 bp, Artificial Sequence
  Description of Artificial Sequence: Synthetic oligonucleotide
acctactggatcacc

SEQ ID NO: 690 - protein, 5 aa, Artificial Sequence
  Description of Artificial Sequence: Synthetic peptide
TYWIT

SEQ ID NO: 691 - DNA, 51 bp, Artificial Sequence; identical to SEQ ID NO: 601
  Description of Artificial Sequence: Synthetic oligonucleotide

SEQ ID NO: 692 - protein, 17 aa, Artificial Sequence
  Description of Artificial Sequence: Synthetic peptide
DIYPGSSICNYNEKFKS

SEQ ID NO: 693 - DNA, 30 bp, Artificial Sequence; identical to SEQ ID NO: 669
  Description of Artificial Sequence: Synthetic oligonucleotide

SEQ ID NO: 694 - protein, 10 aa, Artificial Sequence
  Description of Artificial Sequence: Synthetic peptide
EDGYDAWFAY

SEQ ID NO: 695 - DNA, 15 bp, Artificial Sequence
  Description of Artificial Sequence: Synthetic oligonucleotide
acctactggatcacc

SEQ ID NO: 696 - protein, 5 aa, Artificial Sequence
  Description of Artificial Sequence: Synthetic peptide
TYWIT

SEQ ID NO: 697 - DNA, 51 bp, Artificial Sequence; identical to SEQ ID NO: 601
  Description of Artificial Sequence: Synthetic oligonucleotide

SEQ ID NO: 698 - protein, 17 aa, Artificial Sequence
  Description of Artificial Sequence: Synthetic peptide
DIYPGSSICNYNEKFKS

SEQ ID NO: 699 - DNA, 30 bp, Artificial Sequence; identical to SEQ ID NO: 669
  Description of Artificial Sequence: Synthetic oligonucleotide

SEQ ID NO: 700 - protein, 10 aa, Artificial Sequence
  Description of Artificial Sequence: Synthetic peptide
EDGYDAWFAY

SEQ ID NO: 701 - DNA, 15 bp, Artificial Sequence
  Description of Artificial Sequence: Synthetic oligonucleotide
acctactggatcacc

SEQ ID NO: 702 - protein, 5 aa, Artificial Sequence
  Description of Artificial Sequence: Synthetic peptide
TYWIT

SEQ ID NO: 703 - DNA, 51 bp, Artificial Sequence; identical to SEQ ID NO: 601
  Description of Artificial Sequence: Synthetic oligonucleotide

SEQ ID NO: 704 - protein, 17 aa, Artificial Sequence
  Description of Artificial Sequence: Synthetic peptide
DIYPGSSICNYNEKFKS

SEQ ID NO: 705 - DNA, 30 bp, Artificial Sequence; identical to SEQ ID NO: 669
  Description of Artificial Sequence: Synthetic oligonucleotide

SEQ ID NO: 706 - protein, 10 aa, Artificial Sequence
  Description of Artificial Sequence: Synthetic peptide
EDGYDAWFAY

SEQ ID NO: 707 - DNA, 15 bp, Artificial Sequence
  Description of Artificial Sequence: Synthetic oligonucleotide
acctactggatcacc

SEQ ID NO: 708 - protein, 5 aa, Artificial Sequence
  Description of Artificial Sequence: Synthetic peptide
TYWIT

SEQ ID NO: 709 - DNA, 51 bp, Artificial Sequence; identical to SEQ ID NO: 679
  Description of Artificial Sequence: Synthetic oligonucleotide

SEQ ID NO: 710 - protein, 17 aa, Artificial Sequence
  Description of Artificial Sequence: Synthetic peptide
DIYPGSSICNYADKFKG

SEQ ID NO: 711 - DNA, 30 bp, Artificial Sequence; identical to SEQ ID NO: 669
  Description of Artificial Sequence: Synthetic oligonucleotide

SEQ ID NO: 712 - protein, 10 aa, Artificial Sequence
  Description of Artificial Sequence: Synthetic peptide
EDGYDAWFAY

SEQ ID NO: 713 - DNA, 15 bp, Artificial Sequence
  Description of Artificial Sequence: Synthetic oligonucleotide
acctactggatcacc

SEQ ID NO: 714 - protein, 5 aa, Artificial Sequence
  Description of Artificial Sequence: Synthetic peptide
TYWIT

SEQ ID NO: 715 - DNA, 51 bp, Artificial Sequence; identical to SEQ ID NO: 679
  Description of Artificial Sequence: Synthetic oligonucleotide

SEQ ID NO: 716 - protein, 17 aa, Artificial Sequence
  Description of Artificial Sequence: Synthetic peptide
DIYPGSSICNYADKFKG

SEQ ID NO: 717 - DNA, 30 bp, Artificial Sequence; identical to SEQ ID NO: 669
  Description of Artificial Sequence: Synthetic oligonucleotide

SEQ ID NO: 718 - protein, 10 aa, Artificial Sequence
  Description of Artificial Sequence: Synthetic peptide
EDGYDAWFAY

SEQ ID NO: 719 - DNA, 15 bp, Artificial Sequence
  Description of Artificial Sequence: Synthetic oligonucleotide
acctactggatcacc

SEQ ID NO: 720 - protein, 5 aa, Artificial Sequence
  Description of Artificial Sequence: Synthetic peptide
TYWIT

SEQ ID NO: 721 - DNA, 51 bp, Artificial Sequence
  Description of Artificial Sequence: Synthetic oligonucleotide
gacatctaccccggctcctccatctccaactacgccgactccgtcaagggc

SEQ ID NO: 722 - protein, 17 aa, Artificial Sequence
  Description of Artificial Sequence: Synthetic peptide
DIYPGSSISNYADSVKG

SEQ ID NO: 723 - DNA, 30 bp, Artificial Sequence; identical to SEQ ID NO: 603
  Description of Artificial Sequence: Synthetic oligonucleotide

SEQ ID NO: 724 - protein, 10 aa, Artificial Sequence
  Description of Artificial Sequence: Synthetic peptide
EDGYDAWFAY

SEQ ID NO: 725 - DNA, 15 bp, Artificial Sequence
  Description of Artificial Sequence: Synthetic oligonucleotide
acctactggatcacc

SEQ ID NO: 726 - protein, 5 aa, Artificial Sequence
  Description of Artificial Sequence: Synthetic peptide
TYWIT

SEQ ID NO: 727 - DNA, 51 bp, Artificial Sequence; identical to SEQ ID NO: 625
  Description of Artificial Sequence: Synthetic oligonucleotide

SEQ ID NO: 728 - protein, 17 aa, Artificial Sequence
  Description of Artificial Sequence: Synthetic peptide
DIYPGSSISNYNEKFKS

SEQ ID NO: 729 - DNA, 30 bp, Artificial Sequence; identical to SEQ ID NO: 603
  Description of Artificial Sequence: Synthetic oligonucleotide

SEQ ID NO: 730 - protein, 10 aa, Artificial Sequence
  Description of Artificial Sequence: Synthetic peptide
EDGYDAWFAY

SEQ ID NO: 731 - DNA, 15 bp, Artificial Sequence
  Description of Artificial Sequence: Synthetic oligonucleotide
acctactggatcacc

SEQ ID NO: 732 - protein, 5 aa, Artificial Sequence
  Description of Artificial Sequence: Synthetic peptide
TYWIT

SEQ ID NO: 733 - DNA, 51 bp, Artificial Sequence; identical to SEQ ID NO: 625
  Description of Artificial Sequence: Synthetic oligonucleotide

SEQ ID NO: 734 - protein, 17 aa, Artificial Sequence
  Description of Artificial Sequence: Synthetic peptide
DIYPGSSISNYNEKFKS

SEQ ID NO: 735 - DNA, 30 bp, Artificial Sequence; identical to SEQ ID NO: 669
  Description of Artificial Sequence: Synthetic oligonucleotide

SEQ ID NO: 736 - protein, 10 aa, Artificial Sequence
  Description of Artificial Sequence: Synthetic peptide
EDGYDAWFAY

SEQ ID NO: 737 - DNA, 48 bp, Artificial Sequence
  Description of Artificial Sequence: Synthetic oligonucleotide
agatctagtcagagcattttacatagtaatggaaacacctatttagaa

SEQ ID NO: 738 - protein, 16 aa, Artificial Sequence
  Description of Artificial Sequence: Synthetic peptide
RSSQSILHSNGNTYLE

SEQ ID NO: 739 - DNA, 21 bp, Artificial Sequence
  Description of Artificial Sequence: Synthetic oligonucleotide
aaagtttccaaccgattttct

SEQ ID NO: 740 - protein, 7 aa, Artificial Sequence
  Description of Artificial Sequence: Synthetic peptide
KVSNRFS

SEQ ID NO: 741 - DNA, 27 bp, Artificial Sequence
  Description of Artificial Sequence: Synthetic oligonucleotide
tttcaaggttcacatgttccattcacg

SEQ ID NO: 742 - protein, 9 aa, Artificial Sequence
  Description of Artificial Sequence: Synthetic peptide
FQGSHVPFT

SEQ ID NO: 743 - DNA, 48 bp, Artificial Sequence
  Description of Artificial Sequence: Synthetic oligonucleotide
agatcctcccagtccatcctgcactccaacggcaacacctacctggaa

SEQ ID NO: 744 - protein, 16 aa, Artificial Sequence
  Description of Artificial Sequence: Synthetic peptide
RSSQSILHSNGNTYLE

SEQ ID NO: 745 - DNA, 21 bp, Artificial Sequence
  Description of Artificial Sequence: Synthetic oligonucleotide
aaggtgtccaaccggttctcc

SEQ ID NO: 746 - protein, 7 aa, Artificial Sequence
  Description of Artificial Sequence: Synthetic peptide
KVSNRFS

SEQ ID NO: 747 - DNA, 27 bp, Artificial Sequence
  Description of Artificial Sequence: Synthetic oligonucleotide
tttcaaggctcccacgtgcccttcacc

SEQ ID NO: 748 - protein, 9 aa, Artificial Sequence
  Description of Artificial Sequence: Synthetic peptide
FQGSHVPFT

SEQ ID NO: 749 - DNA, 48 bp, Artificial Sequence; identical to SEQ ID NO: 743
  Description of Artificial Sequence: Synthetic oligonucleotide

SEQ ID NO: 750 - protein, 16 aa, Artificial Sequence
  Description of Artificial Sequence: Synthetic peptide
RSSQSILHSNGNTYLE

SEQ ID NO: 751 - DNA, 21 bp, Artificial Sequence
  Description of Artificial Sequence: Synthetic oligonucleotide
aaggtgtccaaccggttctcc

SEQ ID NO: 752 - protein, 7 aa, Artificial Sequence
  Description of Artificial Sequence: Synthetic peptide
KVSNRFS

SEQ ID NO: 753 - DNA, 27 bp, Artificial Sequence
  Description of Artificial Sequence: Synthetic oligonucleotide
tttcaaggctcccacgtgcccttcacc

SEQ ID NO: 754 - protein, 9 aa, Artificial Sequence
  Description of Artificial Sequence: Synthetic peptide
FQGSHVPFT

SEQ ID NO: 755 - DNA, 48 bp, Artificial Sequence; identical to SEQ ID NO: 743
  Description of Artificial Sequence: Synthetic oligonucleotide

SEQ ID NO: 756 - protein, 16 aa, Artificial Sequence
  Description of Artificial Sequence: Synthetic peptide
RSSQSILHSNGNTYLE

SEQ ID NO: 757 - DNA, 21 bp, Artificial Sequence
  Description of Artificial Sequence: Synthetic oligonucleotide
aaggtgtccaaccggttctcc

SEQ ID NO: 758 - protein, 7 aa, Artificial Sequence
  Description of Artificial Sequence: Synthetic peptide
KVSNRFS

SEQ ID NO: 759 - DNA, 27 bp, Artificial Sequence
  Description of Artificial Sequence: Synthetic oligonucleotide
tttcaaggctcccacgtgcccttcacc

SEQ ID NO: 760 - protein, 9 aa, Artificial Sequence
  Description of Artificial Sequence: Synthetic peptide
FQGSHVPFT

SEQ ID NO: 761 - DNA, 48 bp, Artificial Sequence; identical to SEQ ID NO: 743
  Description of Artificial Sequence: Synthetic oligonucleotide

SEQ ID NO: 762 - protein, 16 aa, Artificial Sequence
  Description of Artificial Sequence: Synthetic peptide
RSSQSILHSNGNTYLE

SEQ ID NO: 763 - DNA, 21 bp, Artificial Sequence
  Description of Artificial Sequence: Synthetic oligonucleotide
aaggtgtccaaccggttctct

SEQ ID NO: 764 - protein, 7 aa, Artificial Sequence
  Description of Artificial Sequence: Synthetic peptide
KVSNRFS

SEQ ID NO: 765 - DNA, 27 bp, Artificial Sequence
  Description of Artificial Sequence: Synthetic oligonucleotide
tttcaaggctcccacgtgcccttcacc

SEQ ID NO: 766 - protein, 9 aa, Artificial Sequence
  Description of Artificial Sequence: Synthetic peptide
FQGSHVPFT

SEQ ID NO: 767 - DNA, 48 bp, Artificial Sequence; identical to SEQ ID NO: 743
  Description of Artificial Sequence: Synthetic oligonucleotide

SEQ ID NO: 768 - protein, 16 aa, Artificial Sequence
  Description of Artificial Sequence: Synthetic peptide
RSSQSILHSNGNTYLE

SEQ ID NO: 769 - DNA, 21 bp, Artificial Sequence
  Description of Artificial Sequence: Synthetic oligonucleotide
aaggtgtccaaccggttctcc

SEQ ID NO: 770 - protein, 7 aa, Artificial Sequence
  Description of Artificial Sequence: Synthetic peptide
KVSNRFS

SEQ ID NO: 771 - DNA, 27 bp, Artificial Sequence
  Description of Artificial Sequence: Synthetic oligonucleotide
tttcaaggctcccacgtgcccttcacc

SEQ ID NO: 772 - protein, 9 aa, Artificial Sequence
  Description of Artificial Sequence: Synthetic peptide
FQGSHVPFT

SEQ ID NO: 773 - DNA, 48 bp, Artificial Sequence; identical to SEQ ID NO: 743
  Description of Artificial Sequence: Synthetic oligonucleotide

SEQ ID NO: 774 - protein, 16 aa, Artificial Sequence
  Description of Artificial Sequence: Synthetic peptide
RSSQSILHSNGNTYLE

SEQ ID NO: 775 - DNA, 21 bp, Artificial Sequence
  Description of Artificial Sequence: Synthetic oligonucleotide
aaggtgtccaaccggttctcc

SEQ ID NO: 776 - protein, 7 aa, Artificial Sequence
  Description of Artificial Sequence: Synthetic peptide
KVSNRFS

SEQ ID NO: 777 - DNA, 27 bp, Artificial Sequence
  Description of Artificial Sequence: Synthetic oligonucleotide
tttcaaggctcccacgtgcccttcacc

SEQ ID NO: 778 - protein, 9 aa, Artificial Sequence
  Description of Artificial Sequence: Synthetic peptide
FQGSHVPFT

SEQ ID NO: 779 - DNA, 48 bp, Artificial Sequence; identical to SEQ ID NO: 743
  Description of Artificial Sequence: Synthetic oligonucleotide

SEQ ID NO: 780 - protein, 16 aa, Artificial Sequence
  Description of Artificial Sequence: Synthetic peptide
RSSQSILHSNGNTYLE

SEQ ID NO: 781 - DNA, 21 bp, Artificial Sequence
  Description of Artificial Sequence: Synthetic oligonucleotide
aaggtgtccaaccggttctcc

SEQ ID NO: 782 - protein, 7 aa, Artificial Sequence
  Description of Artificial Sequence: Synthetic peptide
KVSNRFS

SEQ ID NO: 783 - DNA, 27 bp, Artificial Sequence
  Description of Artificial Sequence: Synthetic oligonucleotide
tttcaaggctcccacgtgcccttcacc

SEQ ID NO: 784 - protein, 9 aa, Artificial Sequence
  Description of Artificial Sequence: Synthetic peptide
FQGSHVPFT

SEQ ID NO: 785 - DNA, 48 bp, Artificial Sequence
  Description of Artificial Sequence: Synthetic oligonucleotide
agatcctcccagtccatcgtgcactccaacggcaacacctacctggaa

SEQ ID NO: 786 - protein, 16 aa, Artificial Sequence
  Description of Artificial Sequence: Synthetic peptide
RSSQSIVHSNGNTYLE

SEQ ID NO: 787 - DNA, 21 bp, Artificial Sequence
  Description of Artificial Sequence: Synthetic oligonucleotide
aaggtgtccaaccggttctcc

SEQ ID NO: 788 - protein, 7 aa, Artificial Sequence
  Description of Artificial Sequence: Synthetic peptide
KVSNRFS

SEQ ID NO: 789 - DNA, 27 bp, Artificial Sequence
  Description of Artificial Sequence: Synthetic oligonucleotide
tttcaaggctcccacgtgcccttcacc

SEQ ID NO: 790 - protein, 9 aa, Artificial Sequence
  Description of Artificial Sequence: Synthetic peptide
FQGSHVPFT

SEQ ID NO: 791 - DNA, 48 bp, Artificial Sequence
  Description of Artificial Sequence: Synthetic oligonucleotide
agatcctcccagtccatcgtgcactccaacggcaacacctacctgaac

SEQ ID NO: 792 - protein, 16 aa, Artificial Sequence
  Description of Artificial Sequence: Synthetic peptide
RSSQSIVHSNGNTYLN

SEQ ID NO: 793 - DNA, 21 bp, Artificial Sequence
  Description of Artificial Sequence: Synthetic oligonucleotide
aaggtgtccaaccggttctcc

SEQ ID NO: 794 - protein, 7 aa, Artificial Sequence
  Description of Artificial Sequence: Synthetic peptide
KVSNRFS

SEQ ID NO: 795 - DNA, 27 bp, Artificial Sequence
  Description of Artificial Sequence: Synthetic oligonucleotide
tttcaaggctcccacgtgcccttcacc

SEQ ID NO: 796 - protein, 9 aa, Artificial Sequence
  Description of Artificial Sequence: Synthetic peptide
FQGSHVPFT

SEQ ID NO: 797 - DNA, 48 bp, Artificial Sequence; identical to SEQ ID NO: 785
  Description of Artificial Sequence: Synthetic oligonucleotide

SEQ ID NO: 798 - protein, 16 aa, Artificial Sequence
  Description of Artificial Sequence: Synthetic peptide
RSSQSIVHSNGNTYLE

SEQ ID NO: 799 - DNA, 21 bp, Artificial Sequence
  Description of Artificial Sequence: Synthetic oligonucleotide
aaggtgtccaaccggttctcc

SEQ ID NO: 800 - protein, 7 aa, Artificial Sequence
  Description of Artificial Sequence: Synthetic peptide
KVSNRFS

SEQ ID NO: 801 - DNA, 27 bp, Artificial Sequence
  Description of Artificial Sequence: Synthetic oligonucleotide
tttcaaggctcccacgtgcccttcacc

SEQ ID NO: 802 - protein, 9 aa, Artificial Sequence
  Description of Artificial Sequence: Synthetic peptide
FQGSHVPFT

SEQ ID NO: 803 - DNA, 48 bp, Artificial Sequence
  Description of Artificial Sequence: Synthetic oligonucleotide
cggtcctcccagtccatcctgcactccaacggcaacacctacctggaa

SEQ ID NO: 804 - protein, 16 aa, Artificial Sequence
  Description of Artificial Sequence: Synthetic peptide
RSSQSILHSNGNTYLE

SEQ ID NO: 805 - DNA, 21 bp, Artificial Sequence
  Description of Artificial Sequence: Synthetic oligonucleotide
aaggtgtccaaccggttctcc

SEQ ID NO: 806 - protein, 7 aa, Artificial Sequence
  Description of Artificial Sequence: Synthetic peptide
KVSNRFS

SEQ ID NO: 807 - DNA, 27 bp, Artificial Sequence
  Description of Artificial Sequence: Synthetic oligonucleotide
tttcaaggctcccacgtgcccttcacc

SEQ ID NO: 808 - protein, 9 aa, Artificial Sequence
  Description of Artificial Sequence: Synthetic peptide
FQGSHVPFT

SEQ ID NO: 809 - DNA, 48 bp, Artificial Sequence; identical to SEQ ID NO: 803
  Description of Artificial Sequence: Synthetic oligonucleotide

SEQ ID NO: 810 - protein, 16 aa, Artificial Sequence
  Description of Artificial Sequence: Synthetic peptide
RSSQSILHSNGNTYLE

SEQ ID NO: 811 - DNA, 21 bp, Artificial Sequence
  Description of Artificial Sequence: Synthetic oligonucleotide
aaggtgtccaaccggttctcc

SEQ ID NO: 812 - protein, 7 aa, Artificial Sequence
  Description of Artificial Sequence: Synthetic peptide
KVSNRFS

SEQ ID NO: 813 - DNA, 27 bp, Artificial Sequence
  Description of Artificial Sequence: Synthetic oligonucleotide
tttcaaggctcccacgtgcccttcacc

SEQ ID NO: 814 - protein, 9 aa, Artificial Sequence
  Description of Artificial Sequence: Synthetic peptide
FQGSHVPFT

SEQ ID NO: 815 - DNA, 48 bp, Artificial Sequence; identical to SEQ ID NO: 803
  Description of Artificial Sequence: Synthetic oligonucleotide

SEQ ID NO: 816 - protein, 16 aa, Artificial Sequence
  Description of Artificial Sequence: Synthetic peptide
RSSQSILHSNGNTYLE

SEQ ID NO: 817 - DNA, 21 bp, Artificial Sequence
  Description of Artificial Sequence: Synthetic oligonucleotide
aaggtgtccaaccggttctcc

SEQ ID NO: 818 - protein, 7 aa, Artificial Sequence
  Description of Artificial Sequence: Synthetic peptide
KVSNRFS

SEQ ID NO: 819 - DNA, 27 bp, Artificial Sequence
  Description of Artificial Sequence: Synthetic oligonucleotide
tttcaaggctcccacgtgcccttcacc

SEQ ID NO: 820 - protein, 9 aa, Artificial Sequence
  Description of Artificial Sequence: Synthetic peptide
FQGSHVPFT

SEQ ID NO: 821 - DNA, 48 bp, Artificial Sequence; identical to SEQ ID NO: 803
  Description of Artificial Sequence: Synthetic oligonucleotide

SEQ ID NO: 822 - protein, 16 aa, Artificial Sequence
  Description of Artificial Sequence: Synthetic peptide
RSSQSILHSNGNTYLE

SEQ ID NO: 823 - DNA, 21 bp, Artificial Sequence
  Description of Artificial Sequence: Synthetic oligonucleotide
aaggtgtccaaccggttctcc

SEQ ID NO: 824 - protein, 7 aa, Artificial Sequence
  Description of Artificial Sequence: Synthetic peptide
KVSNRFS

SEQ ID NO: 825 - DNA, 27 bp, Artificial Sequence
  Description of Artificial Sequence: Synthetic oligonucleotide
tttcaaggctcccacgtgcccttcacc

SEQ ID NO: 826 - protein, 9 aa, Artificial Sequence
  Description of Artificial Sequence: Synthetic peptide
FQGSHVPFT

SEQ ID NO: 827 - DNA, 48 bp, Artificial Sequence; identical to SEQ ID NO: 803
  Description of Artificial Sequence: Synthetic oligonucleotide

SEQ ID NO: 828 - protein, 16 aa, Artificial Sequence
  Description of Artificial Sequence: Synthetic peptide
RSSQSILHSNGNTYLE

SEQ ID NO: 829 - DNA, 21 bp, Artificial Sequence
  Description of Artificial Sequence: Synthetic oligonucleotide
aaggtgtccaaccggttctcc

SEQ ID NO: 830 - protein, 7 aa, Artificial Sequence
  Description of Artificial Sequence: Synthetic peptide
KVSNRFS

SEQ ID NO: 831 - DNA, 27 bp, Artificial Sequence
  Description of Artificial Sequence: Synthetic oligonucleotide
tttcaaggctcccacgtgcccttcacc

SEQ ID NO: 832 - protein, 9 aa, Artificial Sequence
  Description of Artificial Sequence: Synthetic peptide
FQGSHVPFT

SEQ ID NO: 833 - DNA, 48 bp, Artificial Sequence
  Description of Artificial Sequence: Synthetic oligonucleotide
cggtcctcccagtccatcgtgcactccaacggcaacacctacctggaa

SEQ ID NO: 834 - protein, 16 aa, Artificial Sequence
  Description of Artificial Sequence: Synthetic peptide
RSSQSIVHSNGNTYLE

SEQ ID NO: 835 - DNA, 21 bp, Artificial Sequence
  Description of Artificial Sequence: Synthetic oligonucleotide
aaggtgtccaaccggttctcc

SEQ ID NO: 836 - protein, 7 aa, Artificial Sequence
  Description of Artificial Sequence: Synthetic peptide
KVSNRFS

SEQ ID NO: 837 - DNA, 27 bp, Artificial Sequence
  Description of Artificial Sequence: Synthetic oligonucleotide
tttcaaggctcccacgtgcccttcacc

SEQ ID NO: 838 - protein, 9 aa, Artificial Sequence
  Description of Artificial Sequence: Synthetic peptide
FQGSHVPFT

SEQ ID NO: 839 - DNA, 48 bp, Artificial Sequence
  Description of Artificial Sequence: Synthetic oligonucleotide
cggtcctcccagtccatcgtgcactccaacggcaacacctacctgaac

SEQ ID NO: 840 - protein, 16 aa, Artificial Sequence
  Description of Artificial Sequence: Synthetic peptide
RSSQSIVHSNGNTYLN

SEQ ID NO: 841 - DNA, 21 bp, Artificial Sequence
  Description of Artificial Sequence: Synthetic oligonucleotide
aaggtgtccaaccggttctcc

SEQ ID NO: 842 - protein, 7 aa, Artificial Sequence
  Description of Artificial Sequence: Synthetic peptide
KVSNRFS

SEQ ID NO: 843 - DNA, 27 bp, Artificial Sequence
  Description of Artificial Sequence: Synthetic oligonucleotide
tttcaaggctcccacgtgcccttcacc

SEQ ID NO: 844 - protein, 9 aa, Artificial Sequence
  Description of Artificial Sequence: Synthetic peptide
FQGSHVPFT

SEQ ID NO: 845 - DNA, 48 bp, Artificial Sequence; identical to SEQ ID NO: 803
  Description of Artificial Sequence: Synthetic oligonucleotide

SEQ ID NO: 846 - protein, 16 aa, Artificial Sequence
  Description of Artificial Sequence: Synthetic peptide
RSSQSILHSNGNTYLE

SEQ ID NO: 847 - DNA, 21 bp, Artificial Sequence
  Description of Artificial Sequence: Synthetic oligonucleotide
aaggtgtccaaccggttctcc

SEQ ID NO: 848 - protein, 7 aa, Artificial Sequence
  Description of Artificial Sequence: Synthetic peptide
KVSNRFS

SEQ ID NO: 849 - DNA, 27 bp, Artificial Sequence
  Description of Artificial Sequence: Synthetic oligonucleotide
tttcaaggctcccacgtgcccttcacc

SEQ ID NO: 850 - protein, 9 aa, Artificial Sequence
  Description of Artificial Sequence: Synthetic peptide
FQGSHVPFT

SEQ ID NO: 851 - DNA, 48 bp, Artificial Sequence; identical to SEQ ID NO: 743
  Description of Artificial Sequence: Synthetic oligonucleotide

SEQ ID NO: 852 - protein, 16 aa, Artificial Sequence
  Description of Artificial Sequence: Synthetic peptide
RSSQSILHSNGNTYLE

SEQ ID NO: 853 - DNA, 21 bp, Artificial Sequence
  Description of Artificial Sequence: Synthetic oligonucleotide
aaggtgtccaaccggttctcc

SEQ ID NO: 854 - protein, 7 aa, Artificial Sequence
  Description of Artificial Sequence: Synthetic peptide
KVSNRFS

SEQ ID NO: 855 - DNA, 27 bp, Artificial Sequence
  Description of Artificial Sequence: Synthetic oligonucleotide
tttcaaggctcccacgtgcccttcacc

SEQ ID NO: 856 - protein, 9 aa, Artificial Sequence
  Description of Artificial Sequence: Synthetic peptide
FQGSHVPFT

SEQ ID NO: 857 - DNA, 48 bp, Artificial Sequence; identical to SEQ ID NO: 743
  Description of Artificial Sequence: Synthetic oligonucleotide

SEQ ID NO: 858 - protein, 16 aa, Artificial Sequence
  Description of Artificial Sequence: Synthetic peptide
RSSQSILHSNGNTYLE

SEQ ID NO: 859 - DNA, 21 bp, Artificial Sequence
  Description of Artificial Sequence: Synthetic oligonucleotide
aaggtgtccaaccggttctct

SEQ ID NO: 860 - protein, 7 aa, Artificial Sequence
  Description of Artificial Sequence: Synthetic peptide
KVSNRFS

SEQ ID NO: 861 - DNA, 27 bp, Artificial Sequence
  Description of Artificial Sequence: Synthetic oligonucleotide
tttcaaggctcccacgtgcccttcacc

SEQ ID NO: 862 - protein, 9 aa, Artificial Sequence
  Description of Artificial Sequence: Synthetic peptide
FQGSHVPFT

SEQ ID NO: 863 - DNA, 24 bp, Artificial Sequence
  Description of Artificial Sequence: Synthetic oligonucleotide
ggctacaccttcaccacctactgg

SEQ ID NO: 864 - protein, 8 aa, Artificial Sequence
  Description of Artificial Sequence: Synthetic peptide
GYTFTTYW

SEQ ID NO: 865 - DNA, 24 bp, Artificial Sequence
  Description of Artificial Sequence: Synthetic oligonucleotide
atttatcctggtagtagtatttgt

SEQ ID NO: 866 - protein, 8 aa, Artificial Sequence
  Description of Artificial Sequence: Synthetic peptide
IYPGSSIC

SEQ ID NO: 867 - DNA, 36 bp, Artificial Sequence
  Description of Artificial Sequence: Synthetic oligonucleotide
gcaagggaggatggttacgacgcctggtttgcttac

SEQ ID NO: 868 - protein, 12 aa, Artificial Sequence
  Description of Artificial Sequence: Synthetic peptide
AREDGYDAWFAY

SEQ ID NO: 869 - DNA, 24 bp, Artificial Sequence
  Description of Artificial Sequence: Synthetic oligonucleotide
ggctacacctttaccacctactgg

SEQ ID NO: 870 - protein, 8 aa, Artificial Sequence
  Description of Artificial Sequence: Synthetic peptide
GYTFTTYW

SEQ ID NO: 871 - DNA, 24 bp, Artificial Sequence
  Description of Artificial Sequence: Synthetic oligonucleotide
atctaccccggctcctccatctgc

SEQ ID NO: 872 - protein, 8 aa, Artificial Sequence
  Description of Artificial Sequence: Synthetic peptide
IYPGSSIC

SEQ ID NO: 873 - DNA, 36 bp, Artificial Sequence
  Description of Artificial Sequence: Synthetic oligonucleotide
gctagagaggacggctacgacgcttggtttgcctac

SEQ ID NO: 874 - protein, 12 aa, Artificial Sequence
  Description of Artificial Sequence: Synthetic peptide
AREDGYDAWFAY

SEQ ID NO: 875 - DNA, 24 bp, Artificial Sequence
  Description of Artificial Sequence: Synthetic oligonucleotide
ggctacacctttaccacctactgg

SEQ ID NO: 876 - protein, 8 aa, Artificial Sequence
  Description of Artificial Sequence: Synthetic peptide
GYTFTTYW

SEQ ID NO: 877 - DNA, 24 bp, Artificial Sequence
  Description of Artificial Sequence: Synthetic oligonucleotide
atctaccccggctcctccatctgc

SEQ ID NO: 878 - protein, 8 aa, Artificial Sequence
  Description of Artificial Sequence: Synthetic peptide
IYPGSSIC

SEQ ID NO: 879 - DNA, 36 bp, Artificial Sequence; identical to SEQ ID NO: 873
  Description of Artificial Sequence: Synthetic oligonucleotide

SEQ ID NO: 880 - protein, 12 aa, Artificial Sequence
  Description of Artificial Sequence: Synthetic peptide
AREDGYDAWFAY

SEQ ID NO: 881 - DNA, 24 bp, Artificial Sequence
  Description of Artificial Sequence: Synthetic oligonucleotide
ggctacacctttaccacctactgg

SEQ ID NO: 882 - protein, 8 aa, Artificial Sequence
  Description of Artificial Sequence: Synthetic peptide
GYTFTTYW

SEQ ID NO: 883 - DNA, 24 bp, Artificial Sequence
  Description of Artificial Sequence: Synthetic oligonucleotide
atctaccccggctcctccatctgc

SEQ ID NO: 884 - protein, 8 aa, Artificial Sequence
  Description of Artificial Sequence: Synthetic peptide
IYPGSSIC

SEQ ID NO: 885 - DNA, 36 bp, Artificial Sequence; identical to SEQ ID NO: 873
  Description of Artificial Sequence: Synthetic oligonucleotide

SEQ ID NO: 886 - protein, 12 aa, Artificial Sequence
  Description of Artificial Sequence: Synthetic peptide
AREDGYDAWFAY

SEQ ID NO: 887 - DNA, 24 bp, Artificial Sequence
  Description of Artificial Sequence: Synthetic oligonucleotide
ggctacacctttaccacctactgg

SEQ ID NO: 888 - protein, 8 aa, Artificial Sequence
  Description of Artificial Sequence: Synthetic peptide
GYTFTTYW

SEQ ID NO: 889 - DNA, 24 bp, Artificial Sequence
  Description of Artificial Sequence: Synthetic oligonucleotide
atctaccccggctcctccatctgc

SEQ ID NO: 890 - protein, 8 aa, Artificial Sequence
  Description of Artificial Sequence: Synthetic peptide
IYPGSSIC

SEQ ID NO: 891 - DNA, 36 bp, Artificial Sequence; identical to SEQ ID NO: 873
  Description of Artificial Sequence: Synthetic oligonucleotide

SEQ ID NO: 892 - protein, 12 aa, Artificial Sequence
  Description of Artificial Sequence: Synthetic peptide
AREDGYDAWFAY

SEQ ID NO: 893 - DNA, 24 bp, Artificial Sequence
  Description of Artificial Sequence: Synthetic oligonucleotide
ggctacacctttaccacctactgg

SEQ ID NO: 894 - protein, 8 aa, Artificial Sequence
  Description of Artificial Sequence: Synthetic peptide
GYTFTTYW

SEQ ID NO: 895 - DNA, 24 bp, Artificial Sequence
  Description of Artificial Sequence: Synthetic oligonucleotide
atctaccccggctcctccatctcc

SEQ ID NO: 896 - protein, 8 aa, Artificial Sequence
  Description of Artificial Sequence: Synthetic peptide
IYPGSSIS

SEQ ID NO: 897 - DNA, 36 bp, Artificial Sequence; identical to SEQ ID NO: 873
  Description of Artificial Sequence: Synthetic oligonucleotide

SEQ ID NO: 898 - protein, 12 aa, Artificial Sequence
  Description of Artificial Sequence: Synthetic peptide
AREDGYDAWFAY

SEQ ID NO: 899 - DNA, 24 bp, Artificial Sequence
  Description of Artificial Sequence: Synthetic oligonucleotide
ggctacacctttaccacctactgg

SEQ ID NO: 900 - protein, 8 aa, Artificial Sequence
  Description of Artificial Sequence: Synthetic peptide
GYTFTTYW

SEQ ID NO: 901 - DNA, 24 bp, Artificial Sequence
  Description of Artificial Sequence: Synthetic oligonucleotide
atctaccccggctcctccatctcc

SEQ ID NO: 902 - protein, 8 aa, Artificial Sequence
  Description of Artificial Sequence: Synthetic peptide
IYPGSSIS

SEQ ID NO: 903 - DNA, 36 bp, Artificial Sequence; identical to SEQ ID NO: 873
  Description of Artificial Sequence: Synthetic oligonucleotide

SEQ ID NO: 904 - protein, 12 aa, Artificial Sequence
  Description of Artificial Sequence: Synthetic peptide
AREDGYDAWFAY

SEQ ID NO: 905 - DNA, 24 bp, Artificial Sequence
  Description of Artificial Sequence: Synthetic oligonucleotide
ggctacacctttaccacctactgg

SEQ ID NO: 906 - protein, 8 aa, Artificial Sequence
  Description of Artificial Sequence: Synthetic peptide
GYTFTTYW

SEQ ID NO: 907 - DNA, 24 bp, Artificial Sequence
  Description of Artificial Sequence: Synthetic oligonucleotide
atctaccccggctcctccatctcc

SEQ ID NO: 908 - protein, 8 aa, Artificial Sequence
  Description of Artificial Sequence: Synthetic peptide
IYPGSSIS

SEQ ID NO: 909 - DNA, 36 bp, Artificial Sequence; identical to SEQ ID NO: 873
  Description of Artificial Sequence: Synthetic oligonucleotide

SEQ ID NO: 910 - protein, 12 aa, Artificial Sequence
  Description of Artificial Sequence: Synthetic peptide
AREDGYDAWFAY

SEQ ID NO: 911 - DNA, 24 bp, Artificial Sequence
  Description of Artificial Sequence: Synthetic oligonucleotide
ggctacacctttaccacctactgg

SEQ ID NO: 912 - protein, 8 aa, Artificial Sequence
  Description of Artificial Sequence: Synthetic peptide
GYTFTTYW

SEQ ID NO: 913 - DNA, 24 bp, Artificial Sequence
  Description of Artificial Sequence: Synthetic oligonucleotide
atctaccccggctcctccatctcc

SEQ ID NO: 914 - protein, 8 aa, Artificial Sequence
  Description of Artificial Sequence: Synthetic peptide
IYPGSSIS

SEQ ID NO: 915 - DNA, 36 bp, Artificial Sequence; identical to SEQ ID NO: 873
  Description of Artificial Sequence: Synthetic oligonucleotide

SEQ ID NO: 916 - protein, 12 aa, Artificial Sequence
  Description of Artificial Sequence: Synthetic peptide
AREDGYDAWFAY

SEQ ID NO: 917 - DNA, 24 bp, Artificial Sequence
  Description of Artificial Sequence: Synthetic oligonucleotide
ggctacacctttaccacctactgg

SEQ ID NO: 918 - protein, 8 aa, Artificial Sequence
  Description of Artificial Sequence: Synthetic peptide
GYTFTTYW

SEQ ID NO: 919 - DNA, 24 bp, Artificial Sequence
  Description of Artificial Sequence: Synthetic oligonucleotide
atctaccccggctcctccatctgc

SEQ ID NO: 920 - protein, 8 aa, Artificial Sequence
  Description of Artificial Sequence: Synthetic peptide
IYPGSSIC

SEQ ID NO: 921 - DNA, 36 bp, Artificial Sequence; identical to SEQ ID NO: 873
  Description of Artificial Sequence: Synthetic oligonucleotide

SEQ ID NO: 922 - protein, 12 aa, Artificial Sequence
  Description of Artificial Sequence: Synthetic peptide
AREDGYDAWFAY

SEQ ID NO: 923 - DNA, 24 bp, Artificial Sequence
  Description of Artificial Sequence: Synthetic oligonucleotide
ggctacacctttaccacctactgg

SEQ ID NO: 924 - protein, 8 aa, Artificial Sequence
  Description of Artificial Sequence: Synthetic peptide
GYTFTTYW

SEQ ID NO: 925 - DNA, 24 bp, Artificial Sequence
  Description of Artificial Sequence: Synthetic oligonucleotide
atctaccccggctcctccatctgc

SEQ ID NO: 926 - protein, 8 aa, Artificial Sequence
  Description of Artificial Sequence: Synthetic peptide
IYPGSSIC

SEQ ID NO: 927 - DNA, 36 bp, Artificial Sequence; identical to SEQ ID NO: 873
  Description of Artificial Sequence: Synthetic oligonucleotide

SEQ ID NO: 928 - protein, 12 aa, Artificial Sequence
  Description of Artificial Sequence: Synthetic peptide
AREDGYDAWFAY

SEQ ID NO: 929 - DNA, 24 bp, Artificial Sequence
  Description of Artificial Sequence: Synthetic oligonucleotide
ggctacaccttcaccacctactgg

SEQ ID NO: 930 - protein, 8 aa, Artificial Sequence
  Description of Artificial Sequence: Synthetic peptide
GYTFTTYW

SEQ ID NO: 931 - DNA, 24 bp, Artificial Sequence
  Description of Artificial Sequence: Synthetic oligonucleotide
atctaccccggctcctccatctgc

SEQ ID NO: 932 - protein, 8 aa, Artificial Sequence
  Description of Artificial Sequence: Synthetic peptide
IYPGSSIC

SEQ ID NO: 933 - DNA, 36 bp, Artificial Sequence
  Description of Artificial Sequence: Synthetic oligonucleotide
gccaaagaggacggctacgacgcttggtttgcctac

SEQ ID NO: 934 - protein, 12 aa, Artificial Sequence
  Description of Artificial Sequence: Synthetic peptide
AKEDGYDAWFAY

SEQ ID NO: 935 - DNA, 24 bp, Artificial Sequence
  Description of Artificial Sequence: Synthetic oligonucleotide
ggctacaccttcaccacctactgg

SEQ ID NO: 936 - protein, 8 aa, Artificial Sequence
  Description of Artificial Sequence: Synthetic peptide
GYTFTTYW

SEQ ID NO: 937 - DNA, 24 bp, Artificial Sequence
  Description of Artificial Sequence: Synthetic oligonucleotide
atctaccccggctcctccatctgc

SEQ ID NO: 938 - protein, 8 aa, Artificial Sequence
  Description of Artificial Sequence: Synthetic peptide
IYPGSSIC

SEQ ID NO: 939 - DNA, 36 bp, Artificial Sequence
  Description of Artificial Sequence: Synthetic oligonucleotide
gccagagaggacggctacgacgcttggtttgcttac

SEQ ID NO: 940 - protein, 12 aa, Artificial Sequence
  Description of Artificial Sequence: Synthetic peptide
AREDGYDAWFAY

SEQ ID NO: 941 - DNA, 24 bp, Artificial Sequence
  Description of Artificial Sequence: Synthetic oligonucleotide
ggctacaccttcaccacctactgg

SEQ ID NO: 942 - protein, 8 aa, Artificial Sequence
  Description of Artificial Sequence: Synthetic peptide
GYTFTTYW

SEQ ID NO: 943 - DNA, 24 bp, Artificial Sequence
  Description of Artificial Sequence: Synthetic oligonucleotide
atctaccccggctcctccatctgc

SEQ ID NO: 944 - protein, 8 aa, Artificial Sequence
  Description of Artificial Sequence: Synthetic peptide
IYPGSSIC

SEQ ID NO: 945 - DNA, 36 bp, Artificial Sequence; identical to SEQ ID NO: 939
  Description of Artificial Sequence: Synthetic oligonucleotide

SEQ ID NO: 946 - protein, 12 aa, Artificial Sequence
  Description of Artificial Sequence: Synthetic peptide
AREDGYDAWFAY

SEQ ID NO: 947 - DNA, 24 bp, Artificial Sequence
  Description of Artificial Sequence: Synthetic oligonucleotide
ggctacaccttcaccacctactgg

SEQ ID NO: 948 - protein, 8 aa, Artificial Sequence
  Description of Artificial Sequence: Synthetic peptide
GYTFTTYW

SEQ ID NO: 949 - DNA, 24 bp, Artificial Sequence
  Description of Artificial Sequence: Synthetic oligonucleotide
atctaccccggctcctccatctgc

SEQ ID NO: 950 - protein, 8 aa, Artificial Sequence
  Description of Artificial Sequence: Synthetic peptide
IYPGSSIC

SEQ ID NO: 951 - DNA, 36 bp, Artificial Sequence; identical to SEQ ID NO: 939
  Description of Artificial Sequence: Synthetic oligonucleotide

SEQ ID NO: 952 - protein, 12 aa, Artificial Sequence
  Description of Artificial Sequence: Synthetic peptide
AREDGYDAWFAY

SEQ ID NO: 953 - DNA, 24 bp, Artificial Sequence
  Description of Artificial Sequence: Synthetic oligonucleotide
ggctacaccttcaccacctactgg

SEQ ID NO: 954 - protein, 8 aa, Artificial Sequence
  Description of Artificial Sequence: Synthetic peptide
GYTFTTYW

SEQ ID NO: 955 - DNA, 24 bp, Artificial Sequence
  Description of Artificial Sequence: Synthetic oligonucleotide
atctaccccggctcctccatctgc

SEQ ID NO: 956 - protein, 8 aa, Artificial Sequence
  Description of Artificial Sequence: Synthetic peptide
IYPGSSIC

SEQ ID NO: 957 - DNA, 36 bp, Artificial Sequence; identical to SEQ ID NO: 939
  Description of Artificial Sequence: Synthetic oligonucleotide

SEQ ID NO: 958 - protein, 12 aa, Artificial Sequence
  Description of Artificial Sequence: Synthetic peptide
AREDGYDAWFAY

SEQ ID NO: 959 - DNA, 24 bp, Artificial Sequence
  Description of Artificial Sequence: Synthetic oligonucleotide
ggctacaccttcaccacctactgg

SEQ ID NO: 960 - protein, 8 aa, Artificial Sequence
  Description of Artificial Sequence: Synthetic peptide
GYTFTTYW

SEQ ID NO: 961 - DNA, 24 bp, Artificial Sequence
  Description of Artificial Sequence: Synthetic oligonucleotide
atctaccccggctcctccatctgc

SEQ ID NO: 962 - protein, 8 aa, Artificial Sequence
  Description of Artificial Sequence: Synthetic peptide
IYPGSSIC

SEQ ID NO: 963 - DNA, 36 bp, Artificial Sequence; identical to SEQ ID NO: 939
  Description of Artificial Sequence: Synthetic oligonucleotide

SEQ ID NO: 964 - protein, 12 aa, Artificial Sequence
  Description of Artificial Sequence: Synthetic peptide
AREDGYDAWFAY

SEQ ID NO: 965 - DNA, 24 bp, Artificial Sequence
  Description of Artificial Sequence: Synthetic oligonucleotide
ggctacaccttcaccacctactgg

SEQ ID NO: 966 - protein, 8 aa, Artificial Sequence
  Description of Artificial Sequence: Synthetic peptide
GYTFTTYW

SEQ ID NO: 967 - DNA, 24 bp, Artificial Sequence
  Description of Artificial Sequence: Synthetic oligonucleotide
atctaccccggctcctccatctgc

SEQ ID NO: 968 - protein, 8 aa, Artificial Sequence
  Description of Artificial Sequence: Synthetic peptide
IYPGSSIC

SEQ ID NO: 969 - DNA, 36 bp, Artificial Sequence; identical to SEQ ID NO: 939
  Description of Artificial Sequence: Synthetic oligonucleotide

SEQ ID NO: 970 - protein, 12 aa, Artificial Sequence
  Description of Artificial Sequence: Synthetic peptide
AREDGYDAWFAY

SEQ ID NO: 971 - DNA, 24 bp, Artificial Sequence
  Description of Artificial Sequence: Synthetic oligonucleotide
ggctacaccttcaccacctactgg

SEQ ID NO: 972 - protein, 8 aa, Artificial Sequence
  Description of Artificial Sequence: Synthetic peptide
GYTFTTYW

SEQ ID NO: 973 - DNA, 24 bp, Artificial Sequence
  Description of Artificial Sequence: Synthetic oligonucleotide
atctaccccggctcctccatctgc

SEQ ID NO: 974 - protein, 8 aa, Artificial Sequence
  Description of Artificial Sequence: Synthetic peptide
IYPGSSIC

SEQ ID NO: 975 - DNA, 36 bp, Artificial Sequence; identical to SEQ ID NO: 939
  Description of Artificial Sequence: Synthetic oligonucleotide

SEQ ID NO: 976 - protein, 12 aa, Artificial Sequence
  Description of Artificial Sequence: Synthetic peptide
AREDGYDAWFAY

SEQ ID NO: 977 - DNA, 24 bp, Artificial Sequence
  Description of Artificial Sequence: Synthetic oligonucleotide
ggctacaccttcaccacctactgg

SEQ ID NO: 978 - protein, 8 aa, Artificial Sequence
  Description of Artificial Sequence: Synthetic peptide
GYTFTTYW

SEQ ID NO: 979 - DNA, 24 bp, Artificial Sequence
  Description of Artificial Sequence: Synthetic oligonucleotide
atctaccccggctcctccatctgc

SEQ ID NO: 980 - protein, 8 aa, Artificial Sequence
  Description of Artificial Sequence: Synthetic peptide
IYPGSSIC

SEQ ID NO: 981 - DNA, 36 bp, Artificial Sequence; identical to SEQ ID NO: 939
  Description of Artificial Sequence: Synthetic oligonucleotide

SEQ ID NO: 982 - protein, 12 aa, Artificial Sequence
  Description of Artificial Sequence: Synthetic peptide
AREDGYDAWFAY

SEQ ID NO: 983 - DNA, 24 bp, Artificial Sequence
  Description of Artificial Sequence: Synthetic oligonucleotide
ggctacaccttcaccacctactgg

SEQ ID NO: 984 - protein, 8 aa, Artificial Sequence
  Description of Artificial Sequence: Synthetic peptide
GYTFTTYW

SEQ ID NO: 985 - DNA, 24 bp, Artificial Sequence
  Description of Artificial Sequence: Synthetic oligonucleotide
atctaccccggctcctccatctgc

SEQ ID NO: 986 - protein, 8 aa, Artificial Sequence
  Description of Artificial Sequence: Synthetic peptide
IYPGSSIC

SEQ ID NO: 987 - DNA, 36 bp, Artificial Sequence
  Description of Artificial Sequence: Synthetic oligonucleotide
gccaaagaggacggctacgacgcttggtttgcttac

SEQ ID NO: 988 - protein, 12 aa, Artificial Sequence
  Description of Artificial Sequence: Synthetic peptide
AKEDGYDAWFAY

SEQ ID NO: 989 - DNA, 24 bp, Artificial Sequence
  Description of Artificial Sequence: Synthetic oligonucleotide
ggctacaccttcaccacctactgg

SEQ ID NO: 990 - protein, 8 aa, Artificial Sequence
  Description of Artificial Sequence: Synthetic peptide
GYTFTTYW

SEQ ID NO: 991 - DNA, 24 bp, Artificial Sequence
  Description of Artificial Sequence: Synthetic oligonucleotide
atctaccccggctcctccatctcc

SEQ ID NO: 992 - protein, 8 aa, Artificial Sequence
  Description of Artificial Sequence: Synthetic peptide
IYPGSSIS

SEQ ID NO: 993 - DNA, 36 bp, Artificial Sequence; identical to SEQ ID NO: 873
  Description of Artificial Sequence: Synthetic oligonucleotide

SEQ ID NO: 994 - protein, 12 aa, Artificial Sequence
  Description of Artificial Sequence: Synthetic peptide
AREDGYDAWFAY

SEQ ID NO: 995 - DNA, 24 bp, Artificial Sequence
  Description of Artificial Sequence: Synthetic oligonucleotide
ggctacaccttcaccacctactgg

SEQ ID NO: 996 - protein, 8 aa, Artificial Sequence
  Description of Artificial Sequence: Synthetic peptide
GYTFTTYW

SEQ ID NO: 997 - DNA, 24 bp, Artificial Sequence
  Description of Artificial Sequence: Synthetic oligonucleotide
atctaccccggctcctccatctcc

SEQ ID NO: 998 - protein, 8 aa, Artificial Sequence
  Description of Artificial Sequence: Synthetic peptide
IYPGSSIS

SEQ ID NO: 999 - DNA, 36 bp, Artificial Sequence
  Description of Artificial Sequence: Synthetic oligonucleotide
gccagagaggacggctacgacgcttggtttgcctac

SEQ ID NO: 1000 - protein, 12 aa, Artificial Sequence
  Description of Artificial Sequence: Synthetic peptide
AREDGYDAWFAY

SEQ ID NO: 1001 - DNA, 24 bp, Artificial Sequence
  Description of Artificial Sequence: Synthetic oligonucleotide
ggctacaccttcaccacctactgg

SEQ ID NO: 1002 - protein, 8 aa, Artificial Sequence
  Description of Artificial Sequence: Synthetic peptide
GYTFTTYW

SEQ ID NO: 1003 - DNA, 24 bp, Artificial Sequence
  Description of Artificial Sequence: Synthetic oligonucleotide
atctaccccggctcctccatctcc

SEQ ID NO: 1004 - protein, 8 aa, Artificial Sequence
  Description of Artificial Sequence: Synthetic peptide
IYPGSSIS

SEQ ID NO: 1005 - DNA, 36 bp, Artificial Sequence; identical to SEQ ID NO: 939
  Description of Artificial Sequence: Synthetic oligonucleotide

SEQ ID NO: 1006 - protein, 12 aa, Artificial Sequence
  Description of Artificial Sequence: Synthetic peptide
AREDGYDAWFAY

SEQ ID NO: 1007 - DNA, 33 bp, Artificial Sequence
  Description of Artificial Sequence: Synthetic oligonucleotide
cagagcattttacatagtaatggaaacacctat

SEQ ID NO: 1008 - protein, 11 aa, Artificial Sequence
  Description of Artificial Sequence: Synthetic peptide
QSILHSNGNTY

SEQ ID NO: 1009 - DNA, 9 bp, Artificial Sequence
  Description of Artificial Sequence: Synthetic oligonucleotide
aaagtttcc

SEQ ID NO: 1010 - protein, 3 aa, Artificial Sequence
  Description of Artificial Sequence: Synthetic peptide
KVS

SEQ ID NO: 1011 - DNA, 27 bp, Artificial Sequence
  Description of Artificial Sequence: Synthetic oligonucleotide
tttcaaggttcacatgttccattcacg

SEQ ID NO: 1012 - protein, 9 aa, Artificial Sequence
  Description of Artificial Sequence: Synthetic peptide
FQGSHVPFT

SEQ ID NO: 1013 - DNA, 33 bp, Artificial Sequence
  Description of Artificial Sequence: Synthetic oligonucleotide
cagtccatcctgcactccaacggcaacacctac

SEQ ID NO: 1014 - protein, 11 aa, Artificial Sequence
  Description of Artificial Sequence: Synthetic peptide
QSILHSNGNTY

SEQ ID NO: 1015 - DNA, 9 bp, Artificial Sequence
  Description of Artificial Sequence: Synthetic oligonucleotide
aaggtgtcc

SEQ ID NO: 1016 - protein, 3 aa, Artificial Sequence
  Description of Artificial Sequence: Synthetic peptide
KVS

SEQ ID NO: 1017 - DNA, 27 bp, Artificial Sequence
  Description of Artificial Sequence: Synthetic oligonucleotide
tttcaaggctcccacgtgcccttcacc

SEQ ID NO: 1018 - protein, 9 aa, Artificial Sequence
  Description of Artificial Sequence: Synthetic peptide
FQGSHVPFT

SEQ ID NO: 1019 - DNA, 33 bp, Artificial Sequence; identical to SEQ ID NO: 1013
  Description of Artificial Sequence: Synthetic oligonucleotide

SEQ ID NO: 1020 - protein, 11 aa, Artificial Sequence
  Description of Artificial Sequence: Synthetic peptide
QSILHSNGNTY

SEQ ID NO: 1021 - DNA, 9 bp, Artificial Sequence
  Description of Artificial Sequence: Synthetic oligonucleotide
aaggtgtcc

SEQ ID NO: 1022 - protein, 3 aa, Artificial Sequence
  Description of Artificial Sequence: Synthetic peptide
KVS

SEQ ID NO: 1023 - DNA, 27 bp, Artificial Sequence
  Description of Artificial Sequence: Synthetic oligonucleotide
tttcaaggctcccacgtgcccttcacc

SEQ ID NO: 1024 - protein, 9 aa, Artificial Sequence
  Description of Artificial Sequence: Synthetic peptide
FQGSHVPFT

SEQ ID NO: 1025 - DNA, 33 bp, Artificial Sequence; identical to SEQ ID NO: 1013
  Description of Artificial Sequence: Synthetic oligonucleotide

SEQ ID NO: 1026 - protein, 11 aa, Artificial Sequence
  Description of Artificial Sequence: Synthetic peptide
QSILHSNGNTY

SEQ ID NO: 1027 - DNA, 9 bp, Artificial Sequence
  Description of Artificial Sequence: Synthetic oligonucleotide
aaggtgtcc

SEQ ID NO: 1028 - protein, 3 aa, Artificial Sequence
  Description of Artificial Sequence: Synthetic peptide
KVS

SEQ ID NO: 1029 - DNA, 27 bp, Artificial Sequence
  Description of Artificial Sequence: Synthetic oligonucleotide
tttcaaggctcccacgtgcccttcacc

SEQ ID NO: 1030 - protein, 9 aa, Artificial Sequence
  Description of Artificial Sequence: Synthetic peptide
FQGSHVPFT

SEQ ID NO: 1031 - DNA, 33 bp, Artificial Sequence; identical to SEQ ID NO: 1013
  Description of Artificial Sequence: Synthetic oligonucleotide

SEQ ID NO: 1032 - protein, 11 aa, Artificial Sequence
  Description of Artificial Sequence: Synthetic peptide
QSILHSNGNTY

SEQ ID NO: 1033 - DNA, 9 bp, Artificial Sequence
  Description of Artificial Sequence: Synthetic oligonucleotide
aaggtgtcc

SEQ ID NO: 1034 - protein, 3 aa, Artificial Sequence
  Description of Artificial Sequence: Synthetic peptide
KVS

SEQ ID NO: 1035 - DNA, 27 bp, Artificial Sequence
  Description of Artificial Sequence: Synthetic oligonucleotide
tttcaaggctcccacgtgcccttcacc

SEQ ID NO: 1036 - protein, 9 aa, Artificial Sequence
  Description of Artificial Sequence: Synthetic peptide
FQGSHVPFT

SEQ ID NO: 1037 - DNA, 33 bp, Artificial Sequence; identical to SEQ ID NO: 1013
  Description of Artificial Sequence: Synthetic oligonucleotide

SEQ ID NO: 1038 - protein, 11 aa, Artificial Sequence
  Description of Artificial Sequence: Synthetic peptide
QSILHSNGNTY

SEQ ID NO: 1039 - DNA, 9 bp, Artificial Sequence
  Description of Artificial Sequence: Synthetic oligonucleotide
aaggtgtcc

SEQ ID NO: 1040 - protein, 3 aa, Artificial Sequence
  Description of Artificial Sequence: Synthetic peptide
KVS

SEQ ID NO: 1041 - DNA, 27 bp, Artificial Sequence
  Description of Artificial Sequence: Synthetic oligonucleotide
tttcaaggctcccacgtgcccttcacc

SEQ ID NO: 1042 - protein, 9 aa, Artificial Sequence
  Description of Artificial Sequence: Synthetic peptide
FQGSHVPFT

SEQ ID NO: 1043 - DNA, 33 bp, Artificial Sequence; identical to SEQ ID NO: 1013
  Description of Artificial Sequence: Synthetic oligonucleotide

SEQ ID NO: 1044 - protein, 11 aa, Artificial Sequence
  Description of Artificial Sequence: Synthetic peptide
QSILHSNGNTY

SEQ ID NO: 1045 - DNA, 9 bp, Artificial Sequence
  Description of Artificial Sequence: Synthetic oligonucleotide
aaggtgtcc

SEQ ID NO: 1046 - protein, 3 aa, Artificial Sequence
  Description of Artificial Sequence: Synthetic peptide
KVS

SEQ ID NO: 1047 - DNA, 27 bp, Artificial Sequence
  Description of Artificial Sequence: Synthetic oligonucleotide
tttcaaggctcccacgtgcccttcacc

SEQ ID NO: 1048 - protein, 9 aa, Artificial Sequence
  Description of Artificial Sequence: Synthetic peptide
FQGSHVPFT

SEQ ID NO: 1049 - DNA, 33 bp, Artificial Sequence; identical to SEQ ID NO: 1013
  Description of Artificial Sequence: Synthetic oligonucleotide

SEQ ID NO: 1050 - protein, 11 aa, Artificial Sequence
  Description of Artificial Sequence: Synthetic peptide
QSILHSNGNTY

SEQ ID NO: 1051 - DNA, 9 bp, Artificial Sequence
  Description of Artificial Sequence: Synthetic oligonucleotide
aaggtgtcc

SEQ ID NO: 1052 - protein, 3 aa, Artificial Sequence
  Description of Artificial Sequence: Synthetic peptide
KVS

SEQ ID NO: 1053 - DNA, 27 bp, Artificial Sequence
  Description of Artificial Sequence: Synthetic oligonucleotide
tttcaaggctcccacgtgcccttcacc

SEQ ID NO: 1054 - protein, 9 aa, Artificial Sequence
  Description of Artificial Sequence: Synthetic peptide
FQGSHVPFT

SEQ ID NO: 1055 - DNA, 33 bp, Artificial Sequence
  Description of Artificial Sequence: Synthetic oligonucleotide
cagtccatcgtgcactccaacggcaacacctac

SEQ ID NO: 1056 - protein, 11 aa, Artificial Sequence
  Description of Artificial Sequence: Synthetic peptide
QSIVHSNGNTY

SEQ ID NO: 1057 - DNA, 9 bp, Artificial Sequence
  Description of Artificial Sequence: Synthetic oligonucleotide
aaggtgtcc

SEQ ID NO: 1058 - protein, 3 aa, Artificial Sequence
  Description of Artificial Sequence: Synthetic peptide
KVS

SEQ ID NO: 1059 - DNA, 27 bp, Artificial Sequence
  Description of Artificial Sequence: Synthetic oligonucleotide
tttcaaggctcccacgtgcccttcacc

SEQ ID NO: 1060 - protein, 9 aa, Artificial Sequence
  Description of Artificial Sequence: Synthetic peptide
FQGSHVPFT

SEQ ID NO: 1061 - DNA, 33 bp, Artificial Sequence; identical to SEQ ID NO: 1055
  Description of Artificial Sequence: Synthetic oligonucleotide

SEQ ID NO: 1062 - protein, 11 aa, Artificial Sequence
  Description of Artificial Sequence: Synthetic peptide
QSIVHSNGNTY

SEQ ID NO: 1063 - DNA, 9 bp, Artificial Sequence
  Description of Artificial Sequence: Synthetic oligonucleotide
aaggtgtcc

SEQ ID NO: 1064 - protein, 3 aa, Artificial Sequence
  Description of Artificial Sequence: Synthetic peptide
KVS

SEQ ID NO: 1065 - DNA, 27 bp, Artificial Sequence
  Description of Artificial Sequence: Synthetic oligonucleotide
tttcaaggctcccacgtgcccttcacc

SEQ ID NO: 1066 - protein, 9 aa, Artificial Sequence
  Description of Artificial Sequence: Synthetic peptide
FQGSHVPFT

SEQ ID NO: 1067 - DNA, 33 bp, Artificial Sequence; identical to SEQ ID NO: 1055
  Description of Artificial Sequence: Synthetic oligonucleotide

SEQ ID NO: 1068 - protein, 11 aa, Artificial Sequence
  Description of Artificial Sequence: Synthetic peptide
QSIVHSNGNTY

SEQ ID NO: 1069 - DNA, 9 bp, Artificial Sequence
  Description of Artificial Sequence: Synthetic oligonucleotide
aaggtgtcc

SEQ ID NO: 1070 - protein, 3 aa, Artificial Sequence
  Description of Artificial Sequence: Synthetic peptide
KVS

SEQ ID NO: 1071 - DNA, 27 bp, Artificial Sequence
  Description of Artificial Sequence: Synthetic oligonucleotide
tttcaaggctcccacgtgcccttcacc

SEQ ID NO: 1072 - protein, 9 aa, Artificial Sequence
  Description of Artificial Sequence: Synthetic peptide
FQGSHVPFT

SEQ ID NO: 1073 - DNA, 33 bp, Artificial Sequence; identical to SEQ ID NO: 1013
  Description of Artificial Sequence: Synthetic oligonucleotide

SEQ ID NO: 1074 - protein, 11 aa, Artificial Sequence
  Description of Artificial Sequence: Synthetic peptide
QSILHSNGNTY

SEQ ID NO: 1075 - DNA, 9 bp, Artificial Sequence
  Description of Artificial Sequence: Synthetic oligonucleotide
aaggtgtcc

SEQ ID NO: 1076 - protein, 3 aa, Artificial Sequence
  Description of Artificial Sequence: Synthetic peptide
KVS

SEQ ID NO: 1077 - DNA, 27 bp, Artificial Sequence
  Description of Artificial Sequence: Synthetic oligonucleotide
tttcaaggctcccacgtgcccttcacc

SEQ ID NO: 1078 - protein, 9 aa, Artificial Sequence
  Description of Artificial Sequence: Synthetic peptide
FQGSHVPFT

SEQ ID NO: 1079 - DNA, 33 bp, Artificial Sequence; identical to SEQ ID NO: 1013
  Description of Artificial Sequence: Synthetic oligonucleotide

SEQ ID NO: 1080 - protein, 11 aa, Artificial Sequence
  Description of Artificial Sequence: Synthetic peptide
QSILHSNGNTY

SEQ ID NO: 1081 - DNA, 9 bp, Artificial Sequence
  Description of Artificial Sequence: Synthetic oligonucleotide
aaggtgtcc

SEQ ID NO: 1082 - protein, 3 aa, Artificial Sequence
  Description of Artificial Sequence: Synthetic peptide
KVS

SEQ ID NO: 1083 - DNA, 27 bp, Artificial Sequence
  Description of Artificial Sequence: Synthetic oligonucleotide
tttcaaggctcccacgtgcccttcacc

SEQ ID NO: 1084 - protein, 9 aa, Artificial Sequence
  Description of Artificial Sequence: Synthetic peptide
FQGSHVPFT

SEQ ID NO: 1085 - DNA, 33 bp, Artificial Sequence; identical to SEQ ID NO: 1013
  Description of Artificial Sequence: Synthetic oligonucleotide

SEQ ID NO: 1086 - protein, 11 aa, Artificial Sequence
  Description of Artificial Sequence: Synthetic peptide
QSILHSNGNTY

SEQ ID NO: 1087 - DNA, 9 bp, Artificial Sequence
  Description of Artificial Sequence: Synthetic oligonucleotide
aaggtgtcc

SEQ ID NO: 1088 - protein, 3 aa, Artificial Sequence
  Description of Artificial Sequence: Synthetic peptide
KVS

SEQ ID NO: 1089 - DNA, 27 bp, Artificial Sequence
  Description of Artificial Sequence: Synthetic oligonucleotide
tttcaaggctcccacgtgcccttcacc

SEQ ID NO: 1090 - protein, 9 aa, Artificial Sequence
  Description of Artificial Sequence: Synthetic peptide
FQGSHVPFT

SEQ ID NO: 1091 - DNA, 33 bp, Artificial Sequence; identical to SEQ ID NO: 1013
  Description of Artificial Sequence: Synthetic oligonucleotide

SEQ ID NO: 1092 - protein, 11 aa, Artificial Sequence
  Description of Artificial Sequence: Synthetic peptide
QSILHSNGNTY

SEQ ID NO: 1093 - DNA, 9 bp, Artificial Sequence
  Description of Artificial Sequence: Synthetic oligonucleotide
aaggtgtcc

SEQ ID NO: 1094 - protein, 3 aa, Artificial Sequence
  Description of Artificial Sequence: Synthetic peptide
KVS

SEQ ID NO: 1095 - DNA, 27 bp, Artificial Sequence
  Description of Artificial Sequence: Synthetic oligonucleotide
tttcaaggctcccacgtgcccttcacc

SEQ ID NO: 1096 - protein, 9 aa, Artificial Sequence
  Description of Artificial Sequence: Synthetic peptide
FQGSHVPFT

SEQ ID NO: 1097 - DNA, 33 bp, Artificial Sequence; identical to SEQ ID NO: 1013
  Description of Artificial Sequence: Synthetic oligonucleotide

SEQ ID NO: 1098 - protein, 11 aa, Artificial Sequence
  Description of Artificial Sequence: Synthetic peptide
QSILHSNGNTY

SEQ ID NO: 1099 - DNA, 9 bp, Artificial Sequence
  Description of Artificial Sequence: Synthetic oligonucleotide
aaggtgtcc

SEQ ID NO: 1100 - protein, 3 aa, Artificial Sequence
  Description of Artificial Sequence: Synthetic peptide
KVS

SEQ ID NO: 1101 - DNA, 27 bp, Artificial Sequence
  Description of Artificial Sequence: Synthetic oligonucleotide
tttcaaggctcccacgtgcccttcacc

SEQ ID NO: 1102 - protein, 9 aa, Artificial Sequence
  Description of Artificial Sequence: Synthetic peptide
FQGSHVPFT

SEQ ID NO: 1103 - DNA, 33 bp, Artificial Sequence; identical to SEQ ID NO: 1055
  Description of Artificial Sequence: Synthetic oligonucleotide

SEQ ID NO: 1104 - protein, 11 aa, Artificial Sequence
  Description of Artificial Sequence: Synthetic peptide
QSIVHSNGNTY

SEQ ID NO: 1105 - DNA, 9 bp, Artificial Sequence
  Description of Artificial Sequence: Synthetic oligonucleotide
aaggtgtcc

SEQ ID NO: 1106 - protein, 3 aa, Artificial Sequence
  Description of Artificial Sequence: Synthetic peptide
KVS

SEQ ID NO: 1107 - DNA, 27 bp, Artificial Sequence
  Description of Artificial Sequence: Synthetic oligonucleotide
tttcaaggctcccacgtgcccttcacc

SEQ ID NO: 1108 - protein, 9 aa, Artificial Sequence
  Description of Artificial Sequence: Synthetic peptide
FQGSHVPFT

SEQ ID NO: 1109 - DNA, 33 bp, Artificial Sequence; identical to SEQ ID NO: 1055
  Description of Artificial Sequence: Synthetic oligonucleotide

SEQ ID NO: 1110 - protein, 11 aa, Artificial Sequence
  Description of Artificial Sequence: Synthetic peptide
QSIVHSNGNTY

SEQ ID NO: 1111 - DNA, 9 bp, Artificial Sequence
  Description of Artificial Sequence: Synthetic oligonucleotide
aaggtgtcc

SEQ ID NO: 1112 - protein, 3 aa, Artificial Sequence
  Description of Artificial Sequence: Synthetic peptide
KVS

SEQ ID NO: 1113 - DNA, 27 bp, Artificial Sequence
  Description of Artificial Sequence: Synthetic oligonucleotide
tttcaaggctcccacgtgcccttcacc

SEQ ID NO: 1114 - protein, 9 aa, Artificial Sequence
  Description of Artificial Sequence: Synthetic peptide
FQGSHVPFT

SEQ ID NO: 1115 - DNA, 33 bp, Artificial Sequence; identical to SEQ ID NO: 1013
  Description of Artificial Sequence: Synthetic oligonucleotide

SEQ ID NO: 1116 - protein, 11 aa, Artificial Sequence
  Description of Artificial Sequence: Synthetic peptide
QSILHSNGNTY

SEQ ID NO: 1117 - DNA, 9 bp, Artificial Sequence
  Description of Artificial Sequence: Synthetic oligonucleotide
aaggtgtcc

SEQ ID NO: 1118 - protein, 3 aa, Artificial Sequence
  Description of Artificial Sequence: Synthetic peptide
KVS

SEQ ID NO: 1119 - DNA, 27 bp, Artificial Sequence
  Description of Artificial Sequence: Synthetic oligonucleotide
tttcaaggctcccacgtgcccttcacc

SEQ ID NO: 1120 - protein, 9 aa, Artificial Sequence
  Description of Artificial Sequence: Synthetic peptide
FQGSHVPFT

SEQ ID NO: 1121 - DNA, 33 bp, Artificial Sequence; identical to SEQ ID NO: 1013
  Description of Artificial Sequence: Synthetic oligonucleotide

SEQ ID NO: 1122 - protein, 11 aa, Artificial Sequence
  Description of Artificial Sequence: Synthetic peptide
QSILHSNGNTY

SEQ ID NO: 1123 - DNA, 9 bp, Artificial Sequence
  Description of Artificial Sequence: Synthetic oligonucleotide
aaggtgtcc

SEQ ID NO: 1124 - protein, 3 aa, Artificial Sequence
  Description of Artificial Sequence: Synthetic peptide
KVS

SEQ ID NO: 1125 - DNA, 27 bp, Artificial Sequence
  Description of Artificial Sequence: Synthetic oligonucleotide
tttcaaggctcccacgtgcccttcacc

SEQ ID NO: 1126 - protein, 9 aa, Artificial Sequence
  Description of Artificial Sequence: Synthetic peptide
FQGSHVPFT

SEQ ID NO: 1127 - DNA, 33 bp, Artificial Sequence; identical to SEQ ID NO: 1013
  Description of Artificial Sequence: Synthetic oligonucleotide

SEQ ID NO: 1128 - protein, 11 aa, Artificial Sequence
  Description of Artificial Sequence: Synthetic peptide
QSILHSNGNTY

SEQ ID NO: 1129 - DNA, 9 bp, Artificial Sequence
  Description of Artificial Sequence: Synthetic oligonucleotide
aaggtgtcc

SEQ ID NO: 1130 - protein, 3 aa, Artificial Sequence
  Description of Artificial Sequence: Synthetic peptide
KVS

SEQ ID NO: 1131 - DNA, 27 bp, Artificial Sequence
  Description of Artificial Sequence: Synthetic oligonucleotide
tttcaaggctcccacgtgcccttcacc

SEQ ID NO: 1132 - protein, 9 aa, Artificial Sequence
  Description of Artificial Sequence: Synthetic peptide
FQGSHVPFT

SEQ ID NO: 1133 - protein, 4 aa, Homo sapiens
HVPG

SEQ ID NO: 1134 - DNA, 1350 bp, Artificial Sequence
  Description of Artificial Sequence: Synthetic polynucleotide
gaagtgcagctgctggaatctggcggcggactggtgcagcctggcggctctctgagactgtcttgtgccgcctccggctacaccttcaccacctactggatcacctgggtccgacaggctcccggcaagggactggaatgggtcggagacatctaccccggctcctccatctgcaactacgccgacaagttcaagggccggttcaccatctccgtggacaactccaagtccaccgcctacctccagatgaactccctgagagccgaggacaccgccgtgtactactgcgccagagaggacggctacgacgcttggtttgcttactggggccagggcaccctggtcaccgtgtcatctgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcttatattcaaagctcaccgtggacaagagcaggtggcagcaggggaacgtcttctcatgctccgtgatgcatgaggctctgcacaaccactacacgcagaagagcctctccctgtctcccgggaaatga

SEQ ID NO: 1135 - protein, 7 aa, Artificial Sequence
  Description of Artificial Sequence: Synthetic peptide
KHVPGGG

SEQ ID NO: 1136 - protein, 5 aa, Artificial Sequence
  Description of Artificial Sequence: Synthetic peptide
  MOD_RES (2)..(2): Any amino acid
HXPGG

SEQ ID NO: 1137 - protein, 6 aa, Artificial Sequence
  Description of Artificial Sequence: Synthetic peptide
VQIINK

SEQ ID NO: 1138 - protein, 6 aa, Artificial Sequence
  Description of Artificial Sequence: Synthetic peptide
VQIVYK

SEQ ID NO: 1139 - protein, 10 aa, Homo sapiens
HVPGGGSVQI

SEQ ID NO: 1140 - protein, 7 aa, Homo sapiens
HVPGGGN

SEQ ID NO: 1141 - protein, 119 aa, Artificial Sequence; identical to SEQ ID NO: 196
  Description of Artificial Sequence: Synthetic polypeptide

SEQ ID NO: 1142 - protein, 98 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 1143 - protein, 11 aa, Homo sapiens
WGQGTLVTVSS

SEQ ID NO: 1144 - protein, 98 aa, Homo sapiens; identical to SEQ ID NO: 1142

SEQ ID NO: 1145 - protein, 98 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAR

SEQ ID NO: 1146 - protein, 112 aa, Artificial Sequence; identical to SEQ ID NO: 411
  Description of Artificial Sequence: Synthetic polypeptide

SEQ ID NO: 1147 - protein, 100 aa, Homo sapiens
DVVMTQSPLSLPVTLGQPASISCRSSQSLVHSDGNTYLNWFQQRPGQSPRRLIYKVSNRDSGVPDRFSGSGSGTDFTLKISRVEAEDVGVYYCMQGTHWP

SEQ ID NO: 1148 - protein, 10 aa, Homo sapiens
FGQGTKLEIK

SEQ ID NO: 1149 - protein, 100 aa, Homo sapiens
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLP

SEQ ID NO: 1150 - protein, 100 aa, Homo sapiens; identical to SEQ ID NO: 1149

SEQ ID NO: 1151 - protein, 119 aa, Artificial Sequence; identical to SEQ ID NO: 196
  Description of Artificial Sequence: Synthetic polypeptide

SEQ ID NO: 1152 - protein, 119 aa, Artificial Sequence; identical to SEQ ID NO: 205
  Description of Artificial Sequence: Synthetic polypeptide

SEQ ID NO: 1153 - protein, 119 aa, Artificial Sequence; identical to SEQ ID NO: 214
  Description of Artificial Sequence: Synthetic polypeptide

SEQ ID NO: 1154 - protein, 119 aa, Artificial Sequence; identical to SEQ ID NO: 223
  Description of Artificial Sequence: Synthetic polypeptide

SEQ ID NO: 1155 - protein, 119 aa, Artificial Sequence; identical to SEQ ID NO: 232
  Description of Artificial Sequence: Synthetic polypeptide

SEQ ID NO: 1156 - protein, 119 aa, Artificial Sequence; identical to SEQ ID NO: 241
  Description of Artificial Sequence: Synthetic polypeptide

SEQ ID NO: 1157 - protein, 119 aa, Artificial Sequence; identical to SEQ ID NO: 250
  Description of Artificial Sequence: Synthetic polypeptide

SEQ ID NO: 1158 - protein, 119 aa, Artificial Sequence; identical to SEQ ID NO: 259
  Description of Artificial Sequence: Synthetic polypeptide

SEQ ID NO: 1159 - protein, 119 aa, Artificial Sequence; identical to SEQ ID NO: 268
  Description of Artificial Sequence: Synthetic polypeptide

SEQ ID NO: 1160 - protein, 119 aa, Artificial Sequence; identical to SEQ ID NO: 277
  Description of Artificial Sequence: Synthetic polypeptide

SEQ ID NO: 1161 - protein, 119 aa, Artificial Sequence; identical to SEQ ID NO: 286
  Description of Artificial Sequence: Synthetic polypeptide

SEQ ID NO: 1162 - protein, 112 aa, Artificial Sequence; identical to SEQ ID NO: 411
  Description of Artificial Sequence: Synthetic polypeptide

SEQ ID NO: 1163 - protein, 112 aa, Artificial Sequence; identical to SEQ ID NO: 420
  Description of Artificial Sequence: Synthetic polypeptide

SEQ ID NO: 1164 - protein, 112 aa, Artificial Sequence; identical to SEQ ID NO: 429
  Description of Artificial Sequence: Synthetic polypeptide

SEQ ID NO: 1165 - protein, 112 aa, Artificial Sequence; identical to SEQ ID NO: 438
  Description of Artificial Sequence: Synthetic polypeptide

SEQ ID NO: 1166 - protein, 112 aa, Artificial Sequence; identical to SEQ ID NO: 447
  Description of Artificial Sequence: Synthetic polypeptide

SEQ ID NO: 1167 - protein, 112 aa, Artificial Sequence; identical to SEQ ID NO: 456
  Description of Artificial Sequence: Synthetic polypeptide

SEQ ID NO: 1168 - protein, 112 aa, Artificial Sequence; identical to SEQ ID NO: 465
  Description of Artificial Sequence: Synthetic polypeptide

SEQ ID NO: 1169 - protein, 112 aa, Artificial Sequence; identical to SEQ ID NO: 474
  Description of Artificial Sequence: Synthetic polypeptide

SEQ ID NO: 1170 - protein, 112 aa, Artificial Sequence; identical to SEQ ID NO: 483
  Description of Artificial Sequence: Synthetic polypeptide

SEQ ID NO: 1171 - protein, 112 aa, Artificial Sequence; identical to SEQ ID NO: 491
  Description of Artificial Sequence: Synthetic polypeptide

SEQ ID NO: 1172 - protein, 112 aa, Artificial Sequence; identical to SEQ ID NO: 500
  Description of Artificial Sequence: Synthetic polypeptide

SEQ ID NO: 1173 - protein, 112 aa, Artificial Sequence; identical to SEQ ID NO: 581
  Description of Artificial Sequence: Synthetic polypeptide

SEQ ID NO: 1174 - protein, 112 aa, Artificial Sequence; identical to SEQ ID NO: 590
  Description of Artificial Sequence: Synthetic polypeptide

SEQ ID NO: 1175 - protein, 119 aa, Artificial Sequence; identical to SEQ ID NO: 196
  Description of Artificial Sequence: Synthetic polypeptide

SEQ ID NO: 1176 - protein, 98 aa, Homo sapiens
EVQLLESGGGLVQPGGSLRLSCAASGFTFSSYAMSWVRQAPGKGLEWVSVIYSGGSSTYYADSVKGRFTISRDNSKNTLYLQMNSLRAEDTAVYYCAK

SEQ ID NO: 1177 - protein, 11 aa, Homo sapiens
WGQGTLVTVSS

SEQ ID NO: 1178 - protein, 98 aa, Homo sapiens
QVQLVESGGGVVQPGGSLRLSCAASGFTFSSYGMHWVRQAPGKGLEWVAFIRYDGSNKYYADSVKGRFTISRDNSKNTLYLQMNSLRAEDTAVYYCAK

SEQ ID NO: 1179 - protein, 119 aa, Artificial Sequence; identical to SEQ ID NO: 295
  Description of Artificial Sequence: Synthetic polypeptide

SEQ ID NO: 1180 - protein, 112 aa, Artificial Sequence; identical to SEQ ID NO: 411
  Description of Artificial Sequence: Synthetic polypeptide

SEQ ID NO: 1181 - protein, 95 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTP

SEQ ID NO: 1182 - protein, 10 aa, Homo sapiens
FGQGTKLEIK

SEQ ID NO: 1183 - protein, 95 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYP

SEQ ID NO: 1184 - protein, 112 aa, Artificial Sequence; identical to SEQ ID NO: 509
  Description of Artificial Sequence: Synthetic polypeptide

SEQ ID NO: 1185 - protein, 119 aa, Artificial Sequence; identical to SEQ ID NO: 196
  Description of Artificial Sequence: Synthetic polypeptide

SEQ ID NO: 1186 - protein, 119 aa, Artificial Sequence; identical to SEQ ID NO: 295
  Description of Artificial Sequence: Synthetic polypeptide

SEQ ID NO: 1187 - protein, 119 aa, Artificial Sequence; identical to SEQ ID NO: 304
  Description of Artificial Sequence: Synthetic polypeptide

SEQ ID NO: 1188 - protein, 119 aa, Artificial Sequence; identical to SEQ ID NO: 313
  Description of Artificial Sequence: Synthetic polypeptide

SEQ ID NO: 1189 - protein, 119 aa, Artificial Sequence; identical to SEQ ID NO: 321
  Description of Artificial Sequence: Synthetic polypeptide

SEQ ID NO: 1190 - protein, 119 aa, Artificial Sequence; identical to SEQ ID NO: 330
  Description of Artificial Sequence: Synthetic polypeptide

SEQ ID NO: 1191 - protein, 119 aa, Artificial Sequence; identical to SEQ ID NO: 339
  Description of Artificial Sequence: Synthetic polypeptide

SEQ ID NO: 1192 - protein, 119 aa, Artificial Sequence; identical to SEQ ID NO: 348
  Description of Artificial Sequence: Synthetic polypeptide

SEQ ID NO: 1193 - protein, 119 aa, Artificial Sequence; identical to SEQ ID NO: 357
  Description of Artificial Sequence: Synthetic polypeptide

SEQ ID NO: 1194 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYADSVKGRFTISRDNSKNTLYLQMNSLRAEDTAVYYCAREDGYDAWFAYWGQGTLVTVSS

SEQ ID NO: 1195 - protein, 119 aa, Artificial Sequence
  Description of Artificial Sequence: Synthetic polypeptide
EVQLLESGGGLVQPGGSLRLSCAASGYTFTTYWITWVRQAPGKGLEWVSDIYPGSSICNYADSVKGRFTISRDNSKNTLYLQMNSLRAEDTAVYYCAKEDGYDAWFAYWGQGTLVTVSS

SEQ ID NO: 1196 - protein, 119 aa, Artificial Sequence; identical to SEQ ID NO: 1194
  Description of Artificial Sequence: Synthetic polypeptide

SEQ ID NO: 1197 - protein, 119 aa, Artificial Sequence; identical to SEQ ID NO: 384
  Description of Artificial Sequence: Synthetic polypeptide

SEQ ID NO: 1198 - protein, 119 aa, Artificial Sequence; identical to SEQ ID NO: 393
  Description of Artificial Sequence: Synthetic polypeptide

SEQ ID NO: 1199 - protein, 119 aa, Artificial Sequence; identical to SEQ ID NO: 402
  Description of Artificial Sequence: Synthetic polypeptide

SEQ ID NO: 1200 - protein, 112 aa, Artificial Sequence; identical to SEQ ID NO: 411
  Description of Artificial Sequence: Synthetic polypeptide

SEQ ID NO: 1201 - protein, 112 aa, Artificial Sequence; identical to SEQ ID NO: 509
  Description of Artificial Sequence: Synthetic polypeptide

SEQ ID NO: 1202 - protein, 112 aa, Artificial Sequence; identical to SEQ ID NO: 518
  Description of Artificial Sequence: Synthetic polypeptide

SEQ ID NO: 1203 - protein, 112 aa, Artificial Sequence; identical to SEQ ID NO: 527
  Description of Artificial Sequence: Synthetic polypeptide

SEQ ID NO: 1204 - protein, 112 aa, Artificial Sequence; identical to SEQ ID NO: 536
  Description of Artificial Sequence: Synthetic polypeptide

SEQ ID NO: 1205 - protein, 112 aa, Artificial Sequence; identical to SEQ ID NO: 545
  Description of Artificial Sequence: Synthetic polypeptide

SEQ ID NO: 1206 - protein, 112 aa, Artificial Sequence; identical to SEQ ID NO: 554
  Description of Artificial Sequence: Synthetic polypeptide

SEQ ID NO: 1207 - protein, 112 aa, Artificial Sequence; identical to SEQ ID NO: 563
  Description of Artificial Sequence: Synthetic polypeptide

What is claimed:

1. A monoclonal antibody, or an antigen-binding fragment thereof, that specifically binds a human Tau, the antibody comprising a heavy chain complementarity determining region 1 (HCDR1), a heavy chain complementarity determining region 2 (HCDR2), and a heavy chain complementarity determining region 3 (HCDR3) as set forth in SEQ ID NO: 402 and a light chain complementarity determining region 1 (LCDR1), a light chain complementarity determining region 2 (LCDR2), and a light chain complementarity determining region 3 (LCDR3) as set forth in SEQ ID NO: 572.

2. The monoclonal antibody or antigen-binding fragment according to claim 1, wherein:
the HCDR1 comprises SEQ ID NO: 732, the HCDR2 comprises SEQ ID NO: 734, the HCDR3 comprises SEQ ID NO: 736, the LCDR1 comprises SEQ ID NO: 846, the LCDR2 comprises SEQ ID NO: 848, and the LCDR3 comprises SEQ ID NO: 850 as defined according to the method of Kabat; or
the HCDR1 comprises SEQ ID NO: 1002, the HCDR2 comprises SEQ ID NO: 1004, the HCDR3 comprises SEQ ID NO: 1006, the LCDR1 comprises SEQ ID NO: 1116, the LCDR2 comprises SEQ ID NO: 1118, and the LCDR3 comprises SEQ ID NO: 1120 as defined by IMGT.

3. The monoclonal antibody or antigen-binding fragment according to claim 1, wherein the residue at position 49 of the light chain according to the method of Kabat is not cysteine.

4. The monoclonal antibody or antigen-binding fragment according to claim 3, wherein the residue at position 49 of the light chain according to the method of Kabat is serine.

5. The monoclonal antibody or antigen-binding fragment according to claim 1 wherein the residue at position 57 of the heavy chain according to the method of Kabat is not cysteine.

6. The monoclonal antibody or antigen-binding fragment according to claim 5, wherein the residue at position 57 of the heavy chain according to the method of Kabat is serine.

7. The monoclonal antibody or antigen-binding fragment according to claim 1 wherein the residue at position 34 of the light chain according to the method of Kabat is glutamate.

8. The monoclonal antibody or antigen-binding fragment according to claim 1 wherein the residue at position 36 of the light chain according to the method of Kabat is not phenylalanine.

9. The monoclonal antibody or antigen-binding fragment according to claim 8 wherein the residue at position 36 of the light chain according to the method of Kabat is tyrosine.

10. The monoclonal antibody or antigen-binding fragment according to claim 1 wherein the residue at position 46 of the light chain according to the method of Kabat is not arginine.

11. The monoclonal antibody or antigen-binding fragment according to claim 10 wherein the residue at position 46 of the light chain according to the method of Kabat is leucine.

12. The monoclonal antibody or antigen-binding fragment according to claim 1 wherein the residue at position 94 of the heavy chain according to the method of Kabat is not lysine.

13. The monoclonal antibody or antigen-binding fragment according to claim 1 wherein the residue at position 71 of the heavy chain according to the method of Kabat is not arginine.

14. The monoclonal antibody or antigen-binding fragment according to claim 13 wherein position 71 of the heavy chain according to the Kabat method is valine.

15. The monoclonal antibody or antigen-binding fragment according to claim 1, the antibody comprising a HCVD comprising SEQ ID NO: 402 and a LCVD comprising SEQ ID NO: 572.

16. The monoclonal antibody or antigen-binding fragment according to claim 1, wherein the antibody is a humanized antibody.

17. The monoclonal antibody or antigen-binding fragment according to claim 1 wherein the antibody is human IgG1.

18. The monoclonal antibody or antigen-binding fragment according to claim 1 wherein the antibody binds monomeric wild-type human 2N4R Tau with a $K_D$ of less than about 0.5 nM as measured by surface plasmon resonance.

19. The monoclonal antibody or antigen-binding fragment according to claim 1, wherein the antibody or antigen-binding fragment binds to human Tau at an epitope comprising the amino acid sequence HVPG (SEQ ID NO: 1133).

20. The monoclonal antibody or antigen-binding fragment according to claim 19, wherein the antibody or antigen-binding fragment is biepitopic and binds to human Tau at an epitope comprising the amino acid sequence HVPG (SEQ ID NO: 1133) within repeat region 2 or repeat region 4.

21. The monoclonal antibody or antigen-binding fragment according to claim 1, wherein the antibody or antigen-binding fragment binds to human Tau at an epitope comprising the amino acid sequence HVPGG (SEQ ID NO: 79).

22. The monoclonal antibody or antigen-binding fragment according to claim 21, wherein the antibody or antigen-binding fragment is biepitopic and binds to human Tau at an epitope comprising the amino acid sequence HVPGG (SEQ ID NO: 79) within repeat region 2 or repeat region 4.

23. The monoclonal antibody or antigen-binding fragment according to claim 1,
wherein the antibody or antigen-binding fragment binds human Tau at the epitope comprising the amino acid sequence HVPGG (SEQ ID NO: 79) within repeat region 2 with a binding preference that is at least about 10-fold greater than binding at an epitope comprising the amino acid sequence HKPGG (SEQ ID NO: 182) within repeat region 3 or than binding at an epitope comprising the amino acid sequence HQPGG (SEQ ID NO: 183) within repeat region 1, or wherein the antibody or antigen-binding fragment binds human Tau at the epitope comprising the amino acid sequence HVPGG (SEQ ID NO: 79) within repeat region 4 with a binding preference that is at least about 10-fold greater than binding at an epitope comprising the amino acid sequence HKPGG (SEQ ID NO: 182) within repeat region 3 or than binding at an epitope comprising the amino acid sequence HQPGG (SEQ ID NO: 183) within repeat region 1, as determined by a peptide binding assay.

24. A monoclonal antibody, or an antigen-binding fragment thereof, that specifically binds a human Tau, wherein the antibody is produced by the cell line having ATCC deposit number PTA-124524.

25. A pharmaceutical composition comprising the antibody or antigen-binding fragment of claim 1 and a pharmaceutically acceptable carrier.

* * * * *

UNITED STATES PATENT AND TRADEMARK OFFICE
CERTIFICATE OF CORRECTION

PATENT NO. : 10,358,485 B2
APPLICATION NO. : 16/217360
DATED : July 23, 2019
INVENTOR(S) : Roberts et al.

Page 1 of 1

It is certified that error appears in the above-identified patent and that said Letters Patent is hereby corrected as shown below:

In the Specification

Under DETAILED DESCRIPTION OF ILLUSTRATIVE EMBODIMENTS, Column 240, Line 6, Replace "www_ncbi_nlm_nih_gov/igblast" with --www_ncbi_nlm_nih_gov/igblast and--

Under DETAILED DESCRIPTION OF ILLUSTRATIVE EMBODIMENTS, Column 252, Line 37, Replace "DOHC and XOHC" with --D0HC and X0HC--

Under DETAILED DESCRIPTION OF ILLUSTRATIVE EMBODIMENTS, Column 261, Line 61, Replace "RITA) were" with --RIIA) were--

Under DETAILED DESCRIPTION OF ILLUSTRATIVE EMBODIMENTS, Column 262, Line 59, Replace "CD32 Å. 7G6-HCzu25-LCzuI8" with --CD32A. 7G6-HCzu25-LCzuI8--

Signed and Sealed this
Twenty-sixth Day of November, 2019

Andrei Iancu
*Director of the United States Patent and Trademark Office*